United States Patent 7,745,391 (HUMAN THROMBOSPONDIN POLYPEPTIDE) - sequence listing, part 121

SEQ ID NO: 345731 - DNA, 2091 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaaaaaaaaaaaaaaaaaaaaaaaaaaaaaaaaaaaaaaaaaaaaaaaaaaaaaaaggggggggccccccaaaaaatcctcccccgaagggggcgcccaacacgcttcaccgccgagctacccgcgctttctggtggcgacaaaggggggccccatatagggcggagcgcggattatataaagccccgcagacgcgagcgggcgccgcgggtaataaacaacagcggtcggcgagcgggggagaaaagcggctggacccgggggagagctctcttgggggagaaaggagagaaccctctctactctctgtggggggggggggcgagaccatatcttgtggggcgaacaatatctctccttatcgagagaatatttataaagagcctcttaaagggggaaagaatatattaagaaaattttttcaagaaggggggtctatatgcgggggggggatgaaacacccatggggggcgcaaatatgtgtgctgcggcggggcgcgttagtcgaaaaaaaagttttgtggggataaatgcgcgggggtatgatagtattgtttgaggagaaagcacttttttttcacccccggggggggcctctgcggtggtaaa

SEQ ID NO: 345732 - DNA, 760 bp, Homo sapiens
agttgacatgatagaatcgagctcggtacctgaacattcgtgtccctcgcggcagcaacatatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345733 - DNA, 1571 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatggtgagcgggcgggggcggaggggctgctctctgggctgccccttccgcggggccttgtgctgactgcgccccccacacctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345734 - DNA, 1847 bp, Homo sapiens
agcagcatgtggtgtggttggtctttttcgtggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatggtgagcgggcgggggcggaggggctgctctctgggctgccccttccgcggggccttgtgctgactgcgccccccacacctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345735 - DNA, 1371 bp, Homo sapiens
  misc_feature (1355)..(1355): n is a, c, g, or t
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacaacacacaagacacacagccacagatacacatagatagagagctgcacaancatcaacacatatagt

SEQ ID NO: 345736 - DNA, 1420 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345737 - DNA, 980 bp, Homo sapiens
  misc_feature (802)..(802): n is a, c, g, or t
  misc_feature (805)..(805): n is a, c, g, or t
tggtagcgtgcccgagggacacaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaaaaaaaaaaaaaaaaaaaaaaaaaaaaaaaaaaaaaaaaaaaaaaaaaaaaaaaaaaaaaggggggggggcgcgnaanaaagaaactcaccaccaagcgaggggacccccacaatatgacacgagcacaacacaggcaatatagtcaggacaaaacaaggggcgcacccaaaaaaaagagggcgcagcaataaaaagcaacgaatacgaagaagcgaccacgctgtaaaaaaaacgacgaccgcggcaggaac

SEQ ID NO: 345738 - DNA, 1193 bp, Homo sapiens
  misc_feature (1084)..(1084): n is a, c, g, or t
  misc_feature (1125)..(1125): n is a, c, g, or t
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctcaatgataatctttgtattataggaaaagtaaggattagtggaagacagggtttctatccaaaccaacaacataaacggcaatataattgttaaaattagcctttatatgccatatgttatgcctggtacatagtagactcccaataaatctttggtggcttganttgaagaggtaaagttcagatgaaatctttggcctcctttnctggccggggacagtaagattctcatgctaagcaataaaatggtcttatctcttaataatccccatcc

SEQ ID NO: 345739 - DNA, 1041 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcag

SEQ ID NO: 345740 - DNA, 637 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagactcgccaaggatgtgaagcagcaccagcagcaccacaatc

SEQ ID NO: 345741 - DNA, 1484 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345742 - DNA, 265 bp, Homo sapiens
tgctgttctagaggatccctgtgatgttatcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagactcgccaaggatgtgaagcagcaccagcagcaccacaatc

SEQ ID NO: 345743 - DNA, 1760 bp, Homo sapiens
agcagcatgtggtgtggttggtctttttcgtggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345744 - DNA, 1362 bp, Homo sapiens
agcagcatgtggtgtggttggtctttttcgtggcagccagtccactgggtgcgctcggcatgtggctgcagcttgacctgggtttcctggtccctggcaagctccagctcaaggtccctgctgaaggtcggagagcttggcatggccccgtttgtccatgctagggctgggaagaccaaggctcagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345745 - DNA, 1345 bp, Homo sapiens
tggccacatttccagtacccagtagtcatctgtgccagggggttatccaggtacagaacattcccatcgttgcagaaggttctatcagctagcactgggttggacgacacttgccaagacgagctggctagaggatggttctccggacctggtcccacgtggttcccagctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345746 - DNA, 1187 bp, Homo sapiens
gctggcattgggcttgtcacaaggaccagatcgccaaggatgtgaagcagttctatgaccaggccctacagcaggccgtggtggatgatgacgccgacaacgccaaggctgtggtgaagaccttccgcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345747 - DNA, 869 bp, Homo sapiens
ccaagaagcttagtatactagtaaaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgcta

SEQ ID NO: 345748 - DNA, 1752 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaaaaaaaaaaaaaaaaaaaaaaaaaaaaaaaaaaaaaaaaaaaaaaaaaaaaaaacatacacaaaaaacaaaaaaaaaaaaacaaacaactcacccacaaaaaaaacaaaaaaaaaaaaacaaccgggccacaaacaacaaacatacacctcttggtcccgccttcctccacttccctttttatctccaccctttctctctcgcgccctttttatctttttgcccattccccccatacagggctcctcacactacagggcccgcctttc

SEQ ID NO: 345749 - DNA, 1512 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccag

SEQ ID NO: 345750 - DNA, 1464 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccag

SEQ ID NO: 345751 - DNA, 1047 bp, Homo sapiens
ccattgtgctggaaaggcgcgcaacggcggcgacggcggcgaccccaccgcgcatcctgccaggcctccggcgcccagcggcccacgcgcccccgcgtccccgcgccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctggctggctggaggcgtgatcctgggtgtggccctgtggctccgccatgacccgcagaccaccaacctcctgtatctggagctgggagacaagcccgcgcccaacaccttctatgtaggcatctacatcctcatcgctgtgggcgctgtcatgatgttcgttggcttcctgggctgctacggggccatccaggaatcccagtgcctgctggggacgttcttcacctgcctggtcatcctgtttgcctgtgaggtggccgccggcatctggggctttgtcaacaaggaccagatcgccaaggatgtgaagcagttctatgaccaggccctacagcaggccgtggtggatgatgacgccaacaacgccaaggctgtggtgaagaccttccacgagacgcttgactgctgtggctccagcacactgactgctttgaccacctcagtgctcaagaacaatttgtgtccctcgggcagcaacatcatcagcaacctcttcaaggaggactgccaccagaagatcgatgacctcttctccgggaagctgtacctcatcggcattgctgccatcgtggtcgctgtgatcatgatcttcgagatgatcctgagcatggtgctgtgctgtggcatccggaacagctccgtgtactgaggccccgcagctctggccacagggacctctgcagtgccccctaagtgacccggacacttccgagggggaatgttcaggacacgaatgttcaggc

SEQ ID NO: 345752 - DNA, 579 bp, Homo sapiens
tggccacatttccagtacccagtagtcatctgtgccagggggttatccaggtacagaacattcccatcgttgcagaaggttctatcagctagcactgggttggacgacacttgccaagacgagctggctagaggatggttctccggacctggtcccacgtggttcccagctggctggaggcgtgatcctgggtgtggccctgtggctccgccatgacccgcagaccaccaacctcctgtatctggagctgggagacaagcccgcgcccaacaccttctatgtaggtgagtgcacatgtggccgcagacgcattcagggagggcttctaggaggaggcaggtcctagccttttggatggggacatggagggtgaaagacagtcgggcatggcgtgtccgggcagggaggcggccctggaaagggctctgggcacaagggttgagatggaggtgggcctgtggcctgctggcccttctggtctgagccagggcagggggtggcagctaggcctgggcagggactgtgtggagaccttgcttattttaagtgttggggatacatcacggaggctccctgaga

SEQ ID NO: 345753 - DNA, 571 bp, Homo sapiens
gagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcaggtgaggcctctgcccagtgcctggcactccttcttgccccatttttccacccagggtggctcccgactacttctggtagcctcggggacagttgaggtggacaggctggcgtcacccccatttccggctgtccctcccaccccctcctggcccagctgttctgccctattaaaagtcacatgggccctcgggtccttcctggtgttggcccaggctctttcaggccctgcaggccaggaccagccttccctgcaaccctcggcaga

SEQ ID NO: 345754 - DNA, 367 bp, Homo sapiens
aatgtatttcatattaacagacaaaaaaaaacccatatgattaccccaatacattcagaatgcaggagaaacattttgcaaaactaaaaaaaaaaaacaacaacaacaacaaaaaaaagaaaacccaaaaacagctaaaacctttcagcaaactaggactggagacaactctctcaatataataaagtatgtagttgaaaaaaaccctacatcacactcaatgacaaaaggttgtagttaattctcaagtttaaggcaaagatactgctctcattacctatgtgcattattttaatatagtcctagacagtttaataaggaaaaaaagaaggaaaggaaggaagaaagaaagaatgtcaaaggataa

SEQ ID NO: 345755 - DNA, 383 bp, Homo sapiens
gagttaacctcaccgaaagatacaaccgatttaagaagaaaatgttaaaactctcttcaagggcctatagaagaaacgggatgaatggaaacgtgattcactctgtggactggcagatacctctggaaatctggtgttctattgtaataagttctcgggaaggtagagacttttatttgggacatagaggcttggccaaccagaatggaggacccacccaagtcccgcccccaagcctgagccctctcctttgctccacccactctgcctgaagtcccctcaacccctccgacttcgcagtctcccagcccggccttctggggctggtcttcattggaagccacgcccccaggtctgtcggataaacattttacaacctattc

SEQ ID NO: 345756 - DNA, 337 bp, Homo sapiens
agcgacagagtgagactccgtctcaaaaaaaaaaaaaattgcgaaactattattattatctccttttaccagaagagttcactgaggcccgagacgcaaagttatgctttcaaaattacaccaataagttaaccacgggacaggaaaccagcagccagtgttcttggctccaaatttcactgaccagacaatcggatgtattgggtgatattatggctttgcctctgttccctcggatccctttctactgtttttgtagattcccttcgggatttctttgattttcaaaagtgacgtctgctgcttttctgtggagaaccaccatctagcactgggg

SEQ ID NO: 345757 - DNA, 387 bp, Homo sapiens
gtacccaattgcaagcagggaagagaaaatcaaaagaacggatgagacttatatacactgttccttgtagattctggatattgggcctttgtcagatgcatagattgcaaaaattttctcccactctgccaaaagaggagtacatctgaacagcaatagagcagaggaagaaaccctaagtcatgttgtagcctaataccatggagtagcacagactttgaaaccaggcagaaccaggtttgaactttaattgagccacttgctaaatgtatgaccttattatgcgtgttacttaagcttcaacgtcttcacagagaaatggaaataatagtacataacatcactgaattctttggagttaaataagaataaatgtaaaatagcaaa

SEQ ID NO: 345758 - DNA, 1293 bp, Homo sapiens
aaccctcttctgttccaagcactgtgtgagaccctgccttggataagtcaaatgcatgagcttaggaaagtagagtaactgctacaaataataaaaaacagatacatctgcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacccgcactgaaactctgctaccacattgacaaactgaagcaagccaagttctgacgtttttaaaaagacagaagcgaaacccaaaacaacagatcccaagattatcttctgccttaccaatatcccgccaacatcacaaaatagactctcctcttaaaattaacagccacagagacgtggtctttttataaaactgtgtgaatctttgccttttgaagaatttaacatggaccttttcgagaggctcctctgtcttcataatttgccaaaaaattacaaaagcctgtgatttttaacatccctgttatgctgatttctctttaagtgggtcctatttgcataacgagagagtggggaactgaatgcttatgcccaaggagagttctggagggttcaaaggatgaaagaaggacctttgtccctgcggtctctgcagggacaaccccctcagcacatctgcctctaactctgacctggggacctatccatgtgagccttgtttgcctcagtctggaagctgacttctgaagatgactgcctcaccttgcactgtctggacaaacttgaattattttacgccgtgaaagcaacaaaggaaacaaaaaaacatttttttgggcctaagaaaatctgaggaagggggtccttctccgctagagggcagactgcta

SEQ ID NO: 345759 - DNA, 1603 bp, Homo sapiens
gatctgaactgcagagacaaccttagagagaaaatccatactggccagagaccaagttaatggaaaatttaattgaagcaaatgaaatgctcagcctcataggtagtatggccctgtgccctttgaaccagaaaggctgggccaggaggccacagagggccctaagggaaaactcccttatctgcaagaacaaggggcgggactgagtttgagaaaagaaaatctgcaaacctccacaggagcctcagtgaaaggctgcatgcaggggaggaaaccttcaggttttggtcaccaggaagtccgttagagattcacagcagaaggcccctctgcatcccacagcaccaagcacgtgctggaaaccggcggtcccccagaggacagtgggagaggctgccgggtggcagagacacaaccaccaagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacccgcactgaaactctgctaccacattgacaaactgaagcaagccaagttctgacgtttttaaaaagacagaagcgaaacccaaaacaacagatcccaagattatcttctgccttaccaatatcccgccaacatcacaaaatagactctcctcttaaaattaacagccacagagacgtggtctttttataaaactgtgtgaatctttgccttttgaagaatttaacatggaccttttcgagaggctcctctgtcttcataatttgccaaaaaattacaaaagcctgtgatttttaacatccctgttatgctgatttctctttaagtgggtcctatttgcataacgagagagtggggaactgaatgcttatgcccaaggagagttctggagggttcaaaggatgaaagaaggacctttgtccctgcggtctctgcagggacaaccccctcagcacatctgcctctaactctgacctggggacctatccatgtgagccttgtttgcctcagtctggaagctgacttctgaagatgactgcctcaccttgcactgtctggacaaacttgaattattttacgccgtgaaagcaacaaaggaaacaaaaaaacatttttttgggcctaagaaaatctgaggaagggggtccttctccgctagagggcagactgcta

SEQ ID NO: 345760 - DNA, 362 bp, Homo sapiens
aatgcggcaatggacggcagatctgccgttactgcaatgtctaaattgtccttcaattaagctggagagctttctgagagctttaattgatctctttttagatacaatgagctatcaaaaatggaatactgaataacaggcttgttgtccccgtctgctattcaagggaggagggagctatttaaaatgtgttcccagcatattaattgcaggaggccttgactgcactgcagacccacctggaggacgcccttcacaggcaactctttgaagttggaaggacctggcgcagccctccagatgaggcctggtagaggagggcgggcaggacgcccggcttctgcttctcagggtttcgtttc

SEQ ID NO: 345761 - DNA, 453 bp, Homo sapiens
tgctgtctctttcttgggtcttacagcctcctcctctctctcggctcacaatatccaggctgagaattacctggcagtctcccagctcttccttccctcatgcatgcccttctcgatcacagcctcctcctctccctacaggcatccacttggccttttccccctgggcctctgtgctctgctcccagtctttcctgggctttgatccttccctcttcccttccctctagcaccaaactattcaattctgggttactatctgatggctaagaaagagtttcatgaatcttgcagaagttaaggggatcagagtcagaaaccaacgttatgggctggaaggtaactggtaagggagaaaacctctcacccctgagacactgactgccctggacattaaacagcccagacacggcaaccatcacttccaactacttcaggagatgaaaggaacac

SEQ ID NO: 345762 - DNA, 462 bp, Homo sapiens
tggagtataatatggaagtgtatagagtgaaatgggttgcttttcttccatcttttttccccctttacatttgcttttgcttgagtggttggtccctgaagaggcagtaactatgggcatacatatgtgtatgtatgtccctgcaacatttaaagtgtgtaaatgagaagaccttgcctaaacctgaataagagtttacatgattaacctaactaaaccctctctttccttatgtttccacaggagtctccccaggacagtgctatcacccgggatattaaccgaacattcccagcccatgactactttaaggacacaggaggagatggacaagattccttatataaaatatgcaaggtatttcatgtcaaaaaaaaaaaggactcaattctgagtggtggttctactttgaaattacataagaaacaactacaaagtgtaatttgtatttgatgttcaaga

SEQ ID NO: 345763 - DNA, 580 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggtaacagtacttgagtatttcctgcttcttgggcctctccatgatggattgctgtgaaggagaatcaacaatagcaaaccaggaaaaggttgacagtgcagttagcatttatgtcttatttatacatgatttgggaccgttttgccaaacattgaataattttcctgtgggaaacttgagccctaaaaggaaatgaacatagctaaaaggctgcatatcacatgggacttagatttatttttagaatggcactataatgccatatttggattgaaacaatgtgatagcagtaaaatatttcattaaataaagagccatcttttctgaggaagtca

SEQ ID NO: 345764 - DNA, 3399 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccattttaaaatgcttggcaagaataccacacaggtgatgtcagcaaagagttttgagtacctgttatgatctgtactgtgctgaagatcagagatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345765 - DNA, 2490 bp, Homo sapiens
agaatgtaagaagcaaatgagatgttggtccgtgtaaaagttctattatttaccagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345766 - DNA, 1792 bp, Homo sapiens
caccaagcccagcatcctcatgcacactgttcctcttgcaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatattgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345767 - DNA, 1524 bp, Homo sapiens
atatcggtacagtgatctctttagcttctagtatgtgtacggattttttagcatctgtgttcatcagggatattggcttatagtttttagttatgtctatgtctggttttggtatcatggtaatgcttgccttgtagaatgagttcagaataattcccttcttatttttctggaagagtttgagaagaattggtactggttctttaacattttggcagaatttagcagtgaagtcatgtggtcctgggcttttctttgatgggagactttttattactgattcaatctcattactcaatatttatctgttcagatttttaatttcttcttggttcaattttggtaggttgtatgtgtccaggaatttatccatttctttcaggttttccaattggttggcatatagttgttcataatagtctctaatgaccctttgtatttccgtggcatcgtttgtaatgtttattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345768 - DNA, 3052 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatattgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtaggggagggggttgccacttgttacctcccttattacagataacctcagcaagcgttagtacagcca

SEQ ID NO: 345769 - DNA, 1504 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345770 - DNA, 354 bp, Homo sapiens
attactttgttaccttgtcacgtatttgtaagccatttaaattgactttgataaaagtaacattctttagagaatcttatcttccttttatgatttatggtttatggccttatttttaggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggtaagggggtgataattcagcttcagcattaatccttttagagatttgtgatgaaaagatcattatagttatttgacttataag

SEQ ID NO: 345771 - DNA, 321 bp, Homo sapiens
caagaagctaacatgaggttggaacaggaaaacgatgacttagcccatgagctggtgaccagcaagattgcactacggaaggacctggataacgtaagtccaacgggtctgaagggaaagatctcactgagacacttgacttttcccctcaagagaaatcctggaattttagtgattgttattctagccacctgtaaagtttcccgcttgtgatacaacttgcttgtcagtgtcacttccctcctttccttcaggaattatctgttgtctcacaaagccctccttaccacattcttttctcattgtgcacataatccttga

SEQ ID NO: 345772 - DNA, 3309 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345773 - DNA, 2725 bp, Homo sapiens
atctccaacagaactctaaacgcattgagatgtttgggtcctaaggctttaactgacagtattagaatgaacaccctacagacatctccaacagaactctaaacgcattgagaatttggggtcctgggcttataccctactctgatgatttccctccaaaaaaataggaaataccacatccataatgactgagattgcccaggccaccagaagtcttggtcttcagtgcaggcactgaagcacccactactttctaatacttcttaatttaccctatgatttatcctacagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345774 - DNA, 3289 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatattgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345775 - DNA, 1761 bp, Homo sapiens
  misc_feature (7)..(7): n is a, c, g, or t
cagtttntgccgcccgtttctctagaggatccccggcggcaagaggaggaacggcgccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatattgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaaactttgacttttaatttatatagtgatatgctgacaggctgacacgcagatggttttgtcctgttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaacagcattg

SEQ ID NO: 345776 - DNA, 908 bp, Homo sapiens
ataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagcctacccatcatgaggacaaccaggatgaagac

SEQ ID NO: 345777 - DNA, 450 bp, Homo sapiens
actaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaag

SEQ ID NO: 345778 - DNA, 312 bp, Homo sapiens
cgattagtcatattactgttttccagtaagtgataagtcatttttctgtttgtgctttcaagatttttatgttgtatttggttttcagaagtttgagtttgactataaggtatcaagatttacttctctttgtttatttggagtttcttgagattcttggatctgtaggctaatgtttttcttttcttttcttttcttttctttttcttttaaacagacagggtctttttctgtttcccaggctcaagagatcctcccacctcagcctctggagtagctggttacatatcaccacgctgggctaatttttta

SEQ ID NO: 345779 - DNA, 484 bp, Homo sapiens
agcaaggcggtgaacaggctgttcggcgtggaagcctctggaaggagaatctggatccgcagggctgggggtcgctgtctctggcgtgacgacctcctggagcctgccaccaagcccagcatcgctggcaagttcaaggtgctagagcctcccatgctgggccacgacctgagactggccctgtgcttggccaacctcacctcccgggcccagcgggtgagggtcaacctgagcggtgccaccatcctctatacccgcaagccagtggcagagatcctgcatgaatcccacgccgtgaggctggggccgcaagaagagaagagaatcccaattacaatatcttactctaagtataaagaagacctgacagaggacaagaagatcctgttggctgccatgtgccttgtcaccaaaggagagaagcttctggtggagaaggacattactctagaggacttcatcaccatcaaggtgacctcagcct

SEQ ID NO: 345780 - DNA, 275 bp, Homo sapiens
actgtgctacgcaagggcatcaggtccgcccactgctccatctccagcacctaaatggtagcactcactcactcaggctcagccagaccaagtgcctgcctgaaccgcatctacaagccagtattttaggaaattctgttctgtgtcaaagcagcttcactgtagtctactcctgtgtttccccaaattaaacaaagaacagaggtcatgtccgtctggagctagggcggtttattttgtttgtttgtttgttttttcgagacaggatctcgctc

SEQ ID NO: 345781 - DNA, 431 bp, Homo sapiens
gaagttagcatctattatagccatggatgcattttctgttccatctgttacataaaacatatctctatattaaattgttttctttactcttcgtatctgttaacttccctctaatttcttcagtgtcatagtgtattcattttgattgttaatttgttcattaacttatctattcatttattcatttgtttatttaacaaatgatttccatatataagtttacaacagttaacaaagtctgtacctccttacggtttacattctggtacagagagaaatacaataaataaatgaataaatgcatattaggcagtgatatgtgagtgctaatgagacaatacagcattcagacattcgcaatgcatattggttggggataagatttactttttttcaggccgggcgcggtggctcacaactgtaatcccagc

SEQ ID NO: 345782 - DNA, 655 bp, Homo sapiens
cttgggggattatgggccttggtaatcacggaggggaagaagctatgtttatgaggtcctttcaatatttatccaacgcccacagggagcagaggctttgacctcagtggactggatgtgggttatagaacatgaggagttaccctcatcctcagagagcttatggtataaggtgggcttgctaagactcctaaacattcggaaacactgttcctgtcaggtgacacgtgcaaatgcctggaggtgggaaggatctcagcatagtcaaagaacattcacaggtccacgtggctgaattagagggttcctgagtgtaagattctccccggggcctgaaagcttaaggagatgcatcactcctcccttctcaggcccagtcccagggcgcaaggctacttgcgtcagcagcgtgccgaagcaagatagcggaatcaggaagagagccggccggaagacacctgccctggccggaagatacgtacccctgaagatcgagaaagaggccatccgggtatcacgtagcagtttcgtacgactaggagacttcctgttacaggagactatgaaacctttgttccgtcctcacttggggctgacgccattttaggcctcagcccgcctgcatccaggcgctcattaaaacagcatgttgctc

SEQ ID NO: 345783 - DNA, 594 bp, Homo sapiens
catttttttaaaaaaagtaattagattcctagatcatagtgacttgatgtatcattaaaaaaaagtcatgcataatacaacactcactttgtaaggaaagctagctcatttgtagacaggtatccagagttaagagcttcctcgaatttgagggaaggatatttaaatctcattagtaaccaaatcaaaatttttagagtcttactcataagtagtttctatatgtctgctaactggcctagtcaaagccagaggtagttatctatttacttatctagatatataattttatgtctactttaaatagttcttttctatgtagcaggcatagagaactttatccaaactgaatcttgtatgtacatatgtatgcatttggctgtggattcttcataattaatggatggagacaacccaaatgtaaaaagttttagtaaatactgatgcaaaaagtgtagtaggctggtatttttgacctaagcaaaaaagtaattaacataaagagagatattcattgattttttatagtaaaaatttcaaatgacctaaatatccaacactatgggaaatggtttaatacattatggctcacta

SEQ ID NO: 345784 - DNA, 292 bp, Homo sapiens
cattccacatacattatctgatttaacccctctataatgttttaaagatcaagaaactgttactcaaggaacttaagtaaggaacctgctcaagctcccagagctagtaaataacagatccaaaattaaaatagtctcccaattctggatccccaaacctttctactgaacatactgccttcataaaatctcctaccaaattattttaattaagaatgctggatgagcatggtggcatacacctgtaatcctaacactttgggaggccaaggcaggaggatcacttgagccc

SEQ ID NO: 345785 - DNA, 1131 bp, Homo sapiens
aatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaag

SEQ ID NO: 345786 - DNA, 1271 bp, Homo sapiens
gggctggctggccaatggctccactgcccaccctgtggttttccctgtggcggactgtggcaatggtcgggtgggcatagtcagcctgggtgcccgcaagaacctctcagaacgctgggatgcctactgcttccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctacgtgagtgacctgtgcagccctgatgcagtctgggtgtgtgcggttgggtgggtctctgctcaccccgctactgctccagacaggaatctcggggctcacggtggctcagggtagctgcggctagtttcctgcctcacaatcctggtgcccaggtcattgatctgcccgttgcaaagcatttaccaacttgtctgttgcagcggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaag

SEQ ID NO: 345787 - DNA, 551 bp, Homo sapiens
gagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtacctgccatctggcctgggacccacatgtcggttagagaattgggacccggctgtggttaggcggtgggatactaggggtggagttggacaatcagggccctgaaagcccagttcttgttaaggattcaccccctctcgcaggggagagcctggtttatagtcaggaacactcctggagagggagtttctttgttactttgttctagtagacctcccagatagtttcatttttttctactcacctggtttatagtgaagaatgcccctggagagggagtttctttgttactttgttctaatagacctcctagatagttccattttttctattcactaacgtgcactgggaatcc

SEQ ID NO: 345788 - DNA, 1071 bp, Homo sapiens
gggctggctggccaatggctccactgcccaccctgtggttttccctgtggcggactgtggcaatggtcgggtgggcatagtcagcctgggtgcccgcaagaacctctcagaacgctgggatgcctactgcttccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccaccccttgtgccagccatcaaggaggatgctggagggatgatccagaggcttatgcagcagctgctggagtcagacaagtacgcagagcgcaaaggggccgcctatggcctggcgggcctggtgaag

SEQ ID NO: 345789 - DNA, 270 bp, Homo sapiens
gagataggaaattcaatagtgcatgaaaaggacttaacacagtcagattcaatgctcaagacacattaggtttttttctccttctgattatatcattccaagttcaaagattttattttcttctgcctaccaaagttcaacctcctaagtaggttttcttctttgagcatttcagcgtttgttatacacacatctttccagcttctgttcccctgaactctggacacactatcctaggaacacactctttactttactatggcctttgtc

SEQ ID NO: 345790 - DNA, 1184 bp, Homo sapiens
acctggggccccggtgaggttctagcgtgagccccggaaccccaagacaggggtacccggaacgcgcgtgaggaggaggccgctgctaggggaatacccccagccggggtcgtctcgcgggcagtggtggtcagaaggcttttctagcctggatgccacacccaccgggacactcccatggcgccggctgtttcgtttttgctgcccagctatgtcgcggctgcggcccagcgagcgctcccatgttgtcacctggcgctgtggagccgcgggtggagtcgtagctttccaagccaccgccctctctagacatcaggttgaaggagggaattgtcaaccagccgcttgccacggaaccggcctcccccttttaaatgaagcacacaacttccgagcatttcgcggagacccttgaagaggaggcccagggtcccggtggggctggaccctgcccgccacccgcgcttcgtgtggtcgctcccccaaccaggcgggaccggagcctcctatcaaaccggacgatgacagacagactcttttaaccttagatgagaaatggacaaaatggagcttgtgattctgccctaactttcgggagtggcctattctgtggcttcaacctagaaatttcttttccttttcatgtttaggactttactcctttctgaaggggcaggatgggaaggggattaacctgtcctagagacagactgaggagcactaaagaagagcagctcatgtccattcaccccgggttaacaatgcagtttttaccctaatgattctccagtggggcagggccaggaatgacgtccttatggcatgattccaaactttaagtttttagaaatgtccatcagttgttctcttttaagtgaagtggaggtcgttgctggtgggaatgatccctaacttggagataagggaggatggacgactcatgatttctgccctagcagctaaaagtcatccctgcaacaaaattcttaactcccatccggctcccccaccatacccggctcccctgcagtcttccttctctggcaccacctgtccacatctctctccctctctcactgtaggttccctactgtatattaatactgcccaaaattgtaaaaatgtgtacctttgatcaactattttatcctccaaatacaaattcctcgaatcaacctgaaatc

SEQ ID NO: 345791 - DNA, 694 bp, Homo sapiens
tgtttactgacaattgaccaacatgaatgtggtcaggtttagatgaatatctatacaactcacataatttttaatgaagggagttaaaagctaagcatgccaagaaaataagtatgactcaaaagtggccctttcttagtatattggatgtattatggcttctagttaccaagggcctttgaagatgactgggccattattttaatactttttaatatgcttctggattcaattattgcagatttttacaattatatttgatctctagttagtttataaggaggacactatctttgtcaggttttaatatcaagattgtgatagctttgtaagtaaatgtagatattttctatactttttctttgctttagaacagttgaaatagaacaagatcaatctgacatctaatgtttggttgaactcacttgtaaaactgtctgagccccttgacttccaaaggtaggtttttgataattcttgctatagtttaacatatcacacatatggaagactttatttatctatgttcaatctagagaatagtaatggaaggattacacatgttctcaccactgagttgcagaaacagaacactatcagtgtctttgaaggtcactgtgttcccgtacctgatcacctcctcctctctgccctaacccccatttgacgtaaacaacacgcgctaactttggta

SEQ ID NO: 345792 - DNA, 463 bp, Homo sapiens
taaaaataaaaattggtgaatttgagtaagagtatatgggagttctttgcactattcttgcagcttttctgtaagcttaaaattacataattggattcatgtggacataaagatgggaccaatagacactggagactccaaaaggaggaaaggcgagcaaggctgaaaaccttcctattggggactatgttcactatctgggtaatgggaccaatagaaagaagcccaaaccccagccccatatgacatactcttgtaacaaatctacacatggacccccctgaatctaaaataaaaatgaaaatgtaaagataaaattacatcaaaactttaagttcccaaggaaaagaggaaaaacttatttaagaaggagagcgaggccaggtgcagtggctcacgcctatcatcccaacattttgagaggcctaggcaggaggctcacttgagcccaggagttaaagac

SEQ ID NO: 345793 - DNA, 1310 bp, Homo sapiens
  misc_feature (509)..(509): n is a, c, g, or t
  misc_feature (511)..(511): n is a, c, g, or t
gagctcggtacccaaagagtgtctatccagacgtaggacaggttcacagagtccttatctcctgtgactgtggtcttgctgcctttgatttggggctttgctactactggacttagctcagtgactatgatcgtcttgactgttgtcctgttgcagccagtgactgagttattggcgtggcaggtataggatccactattattcacagtgatgttagggataaagagctcttgctctgctttgctgggtcctacgtcttgattgacactccccaaagagtgtcaatcaagacgtaggactactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggntnctatctacttcaaattcctcctgtacgaaaggacaagagaaataaggcctacttcacaaatgcgccttcccccggtacatgatactcatctcaactcagtatcatacccaccacccacccaagaacagggcccgtccaccacaaaacaccacacccaaccccaccaccccacacacagcccaccccccccacccccgaaaaaccacaccacaacacacacgacagcacgcgggcacccgggcacccaagacaacgacaagacccacccatgcaccaacccaggcgatcacccaacggacacacatgcccccacaccaaccgagcacaacaaagatcaaaccacccaaaaactacaaagaaaacccacggagagaaagcacaaacgagcctccagcaagacacctccccagagcacgcgacgcccacccagacacaaaacggcgcaaacatcaaacaccgaatacaaaagcgactcgcagcgaacaaaacactccccccccccccacacgacgggcgaccaaaccaccgcaccccccgcccaaccccgcgacgcccagaacgcgctccaacaactagcacaagccggagacggggggacaagaaggcgcacaacagccgtcagtgtgtgagaggcggcgagagagagaagagtagaagcgcaaagcagagagccgacggcggggcgtcagagcagcacagagaggacagccccggcgagcacaaccacacggacgggcgacaagaagatctagagagtcgaaggcacaccactcacgtgacgcgtctgaggcctacgcac

SEQ ID NO: 345794 - DNA, 1113 bp, Homo sapiens
  misc_feature (312)..(312): n is a, c, g, or t
  misc_feature (314)..(314): n is a, c, g, or t
taccaaacctgcagtaaaaatttcggttggggcgacctcggagcacgaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggntnctatctacttcaaattcctcctgtacgaaaggacaagagaaataaggcctacttcacaaatgcgccttcccccggtacatgatactcatctcaactcagtatcatacccaccacccacccaagaacagggcccgtccaccacaaaacaccacacccaaccccaccaccccacacacagcccaccccccccacccccgaaaaaccacaccacaacacacacgacagcacgcgggcacccgggcacccaagacaacgacaagacccacccatgcaccaacccaggcgatcacccaacggacacacatgcccccacaccaaccgagcacaacaaagatcaaaccacccaaaaactacaaagaaaacccacggagagaaagcacaaacgagcctccagcaagacacctccccagagcacgcgacgcccacccagacacaaaacggcgcaaacatcaaacaccgaatacaaaagcgactcgcagcgaacaaaacactccccccccccccacacgacgggcgaccaaaccaccgcaccccccgcccaaccccgcgacgcccagaacgcgctccaacaactagcacaagccggagacggggggacaagaaggcgcacaacagccgtcagtgtgtgagaggcggcgagagagagaagagtagaagcgcaaagcagagagccgacggcggggcgtcagagcagcacagagaggacagccccggcgagcacaaccacacggacgggcgacaagaagatctagagagtcgaaggcacaccactcacgtgacgcgtctgaggcctacgcac

SEQ ID NO: 345795 - DNA, 644 bp, Homo sapiens
aggagatctacacttgtcatttttaaaagctattgtgacaccagcgttttctcagaagatctaaattttcattggataatttaattgctcctaagcaaagtaatgctggatccccagagaaagatgtatgtgtgtgtgtgacttcaggctcaagaataaaatgagggaagaaagaaatatatttataactgtgaacaattggaagcttggaaacagaatccaacttgaacagtatgagaatggttatattaatttcatactctgaaacctgattggagctccactgaagcagctctttgtttgctaaggtggcatagcaacagcagacacgtctgttttctcattgcaccatcacggacatggtccagcctgtgtgtgaccatcggagactagcgatcatcattcctgtcagtcatcaccatgtctttcacgttcatcttcagtggctctttatcttcatgtctacatctctatgtagacatgctgcatctagagacattggctaccaaggggtttaaggcatctctgtttctattttctgcatacccacagataaacaacaaagccaacgtggtaaccagccccaaagaaaatattcctaccccagcgctggtatacctggactctttgtaacccttcttaag

SEQ ID NO: 345796 - DNA, 445 bp, Homo sapiens
cactcattagttattgtactaaacacaataagatgaagataacaaaaaaaaattttaagagaaaacaaattagagtcctgcttaaaaaatacagatgttctggaatatcaagcaacaatttcaagctttcacacttctggattgaaacacagtttaaagagggaataaaaacctgaagaaagagccacaggactggactgagctaaggcatgttaatagccatgttctagagaaacgatctatgaactcctctgctgaggtccccacacctgtccttgttctctttcttcccgaggctgagtgtctttcctgctgttctgtgatgcttttgcaacactaatgaataaatctctctccaggaattgttttctttttcatgaaacacctctctcctcccttatctcaccacaaaaaagtaaaaaaataaaagaatatttaatgttca

SEQ ID NO: 345797 - DNA, 373 bp, Homo sapiens
tgattggtctagaaataaaagcaatggaatgaaattttgtcaattttatctcttccagggaataaaaacctgaagaaagagccacaggactggactgagctaaggcatgttaatagccatgttctagagaaacgatctatgaactcctctgctgaggtccccacacctgtccttgttctctttcttcccgaggctgagtgtctttcctgctgttctgtgatgcttttgcaacactaatgaataaatctctctccaggaattgttttctttttcatgaaacacctctctcctcccttatctcaccacaaaaaagtaaaaaaataaaagaatatttaatgttcagaatccacaagttattgaaacaaagctcctt

SEQ ID NO: 345798 - DNA, 239 bp, Homo sapiens
tgcaaactctgcctcccgggtacaagtgattctcctgcctcagcctctcaagtagctgggattacagggataaaagcaaacattaaacataaaatccgccctcaagaagcctattttcgcaaacaatcatcttccatacccactttgatgagataatcatctaatgaaaacaaattgatggtaatcaaattgatggtatacattaaaagaggtaaaaattaaagacaaaagaagtattg

SEQ ID NO: 345799 - DNA, 381 bp, Homo sapiens
agaagggcagtatatttcagcaccataaaaagtgacatgcgtttcagaaactgatcagttcctcaatcaccacccacccccagcctgccccagcctccctgttcatgacgtaagggctcacatttgatggtggaacaggctcccaactcacgtgggcaactgtccaaatcacctgataatgggtgcatcccatccattcccccctacaggggagccccgtgtggcgttcacgcacacatggctgggcactccaatcacaattaccagagaactttcatactcacagcaagaagctgttcaggaattattatccttctctcaaaatcatgaatgcttaaacttagtatatatgaaatcatgagagtggcaatgttacacttc

SEQ ID NO: 345800 - DNA, 246 bp, Homo sapiens
taaatgaaaataaatatacaacttatgagaactgtggaatgtagcaaaagagtttttgcattggaaaattttagcatttaatgcatatattagaaaagaagaaagatctaaaatgaactttctaagtttacaacttaggaaactagaaaaatatgagcaaattaaattcaaagtaagatgaaaagaaaattagaattagagcagaaatataatgaaaaacaaaatcaatagagaaaatcaatacaa

SEQ ID NO: 345801 - DNA, 696 bp, Homo sapiens
tgccatctcctcagtctcgccactccaccccagcctctggtaaccttcattttactctctgtttctatgtgtttgtcttttttatactccatatataagtgagatcataagtgaggtatttgtctttctgtgtctggtttatttcgctaaacataatgtcttccaagttcatccatgttttcacaaatgacatgatgataggatttccattgtgtggaaattttccttataattcatagaagattataggtcattgagtatgtgactttagctatgagattgtcctattgggcctttattgtgttgaggtacattccttctaaacctaattttttgagagttttttttcctaatccttaaaggatgttgaattttgttgaataacttttctgcatctgttgagattatcatatggttattgtcctttattctgatgtgatatatcacagtttttgatttgcatatggtgaaccatccttgcatcccagggataaatcttacttgatcaaggtgaatgctccttttaatgtgctgttcaattttgtttgcaaatattttgttgaggatttttgcatccatgttcatcaggaatattggtctgtaattttctttactggtctttggtatcaggaagacgctggccttataaaacaaatttggaagtttcccttctcttcaattttttggaaaagttag

SEQ ID NO: 345802 - DNA, 1367 bp, Homo sapiens
gaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttttgaggtga

SEQ ID NO: 345803 - DNA, 121 bp, Homo sapiens
gggcatgtaattggctaaatccaaaggtccttcgtgaggctacatataacaggaagcagaaccacagtaccaaccagagaggcaccggcatcacagcctgctgcctgaccccaagcacagg

SEQ ID NO: 345804 - DNA, 295 bp, Homo sapiens
atcccatggcctaaaagacaggtttccatggagagtggaggaattctgaggtcagccagcagtgttaacgccctcagaaaccctgatgtagaaaggactgtgaagaaaagtctgtgactctgctctgtgccccttgcttggctgttcaaggtaaaaagctccagctcacagagtgaaagcctgctcgcccttctccctcacaatcaagcacttgcgtccattgcccttggtgtacgtgcaagggtgaggaccagactcttctctgcatttgtggccatagccaaaatgccagagc

SEQ ID NO: 345805 - DNA, 975 bp, Homo sapiens
gcctggtggcgaattcggcacgagggaagtctgcttgaaaggaggtagtagtccagaaaaagattttgttttgctttatgaaaaggaagcaggaggagaaagtattattttttgtctttagatttaccatgagcatgtgatgcttaggctacggcagccatcttggtaccctgagaagagtcaccctaagagaagatgccagcattctaggaaaagcagggcggggatggagaaaaaatccagggcctggatgacattgctgagctgctgagttaacctagaactatcctaactcaagatttctctttataagaatctctcttgcaggagtaacacaggcatgtggagaatttctcagagtatttccgcagcaaccaactggcatgaagaatactttgctgaaacatggggttcaaaagcagcccacagctctctttcggacctctgaagtcacacccagtggtctagtcaacatttcctcttgcagagattgtaaaggtttcaatcttaacaccatgtgactaattcggtctctatgatcaaagccttataagaaagaatgactggttgacccgacatggaccaagtgaccgttcttgttcccagtgtgttgtgggctaagaagagatgggcacagaatgatgggaacgcagagcgaaagggcccaactctaccaggaggggaagataaaaactcctgaagaaattataccaaaaatagaatacttacaacagaattctcaacatcatttttccctgtttgaatccagcaagtcagccattggtcacttaagagcactaacccctccctggtttgaagatgttcttgactttaaatacaaacatctgatattccagcttagactcctccacaagaactagagtgtcatcctattttggcttccagctcagtccctctgctacaagtcttgactccagaactctgtgggataataaaatacaagatcatagcttg

SEQ ID NO: 345806 - DNA, 630 bp, Homo sapiens
aagacattttatgatatattattgagaaatatacattataatttagaaagatagtataagttcatagaaatatggataattaagtgttcatgtgtaatatagttacaggaaaatatttcctaaaggttcttagaaactttaggaattatgtcccaggcattgtaatttagggataagtttctttaggattttgaatatttatctcaatgttagtccaaaaataggaatcacaaattctgatgatataatttatagaaattaatattactttttatggagatgaatttatgtgttgattttcattcatttttttaaaaaaaatctaacaaccaagtctattactagatgcatattcagaaatttttattatggttagaaaccatggaatcgtagaaggggctgtgttttatggattgaacttaatgaagagccacttacaagacatctgagattatggatttggatatataattgtcagttgactttgggttagcatgagtttaaataattctggacttcttaaaaataatattgaaaaagtactagtttatttaagttgattgtgaatttgcttattttggtggtcagtaaaataaccctgggttatttggattattcctctatattact

SEQ ID NO: 345807 - DNA, 630 bp, Homo sapiens
taattagcaaataagatatttgaggacaactttacagattaccagggtaatgaaaaggaagtaatcaaagataagccccataaggatcaaatagcactgtaagtacagtaaaatgtttcttgattaaaatatggatcatgttgccacaggttaattacatgaaagaatgaatctcttgcagaggatgggagccagttgcacaatatctgaatatatgttatcccagggtttcttggaatctaaggaaaaaagcagagcaccagaaatgcaaaaagtaaattgcccatagttaaaggaacatctgagtagtcagatcattaaaatttatgaaacaattatttttcacaagtcatggtggctgaaatagagtgtataatttttttcctttcaaataagcgtattttcctcatattacactgacttaaaatttaaaaattactttgtaatgttgaaacctatagactgtggctcctgtaaaccccaggtcattttcctgccattcttacaactctgtctaagatctataaaagtatattctgctttttgttaggccattcatgcttttttcaacctgtacattctatgtatataatattgttcttggtgctaaatacactttcttttatctga

SEQ ID NO: 345808 - DNA, 173 bp, Homo sapiens
gtgaggaagtccccagacataggaaggaggtcagatgccagactggcacacaatgacagatgtacttgacagcaagtttgccagcttgtgggattgtctgggaatctgcatttaaaccagcaccctggaaattcccatgcaggtgctgcctgaaccacatttgcatccattgc

SEQ ID NO: 345809 - DNA, 472 bp, Homo sapiens
tctgacacttgttaaaatggtaaggaagactttatttgggactattgcaataggggaaagagatggagctcaactctgaatataagaacaagggagaatgacagccaacaagcagagtgagaggactgctggatggaaaactactaagaggagacaccacaattagggagattcttacaaaactcacctaacaggattcttgctgagggcaggccaacggcccaacatcaagggtggggaaatgaggaacttgatcaatattaagggtgatcagataccaagggtaggaggattcccactaaactgacttggaagaattcttgctaaaggcagaccaggagggagggagaagaggaaggaaacgaggggacgcagacggaggggagcagagaggcaggatgggatacagagggatgaagggagggagagatacgaagggagggaatggcgggaaggaatgtcaggggaggaa

SEQ ID NO: 345810 - DNA, 140 bp, Homo sapiens
tgagttggagcactgtgtattaagcatatggagggaagacatacgtgtgtatacacacacaggagtaggccctgctctctgaaaacttaccatattgtcatggagacctggaagataactaaggaagaagtaacaaagcc

SEQ ID NO: 345811 - DNA, 270 bp, Homo sapiens
caggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaag

SEQ ID NO: 345812 - DNA, 400 bp, Homo sapiens
acactcccagacatacccacgtctagcctctgacccggaacagtttctcagaccttcaacctcttcctgtttcttagatgcactgacccctaaactcctaacagcttgatagaactccttccccacacctacctactaggaccctgtgatacactgatttttgattacttcatgctacctagacttgactgcctcactcttaggttattaggtacttaatactgctatcttcagctcacatctgtggtagtacccattgcttcagaaaaacccttaatcacagctccctgccctgtgacttttccctgtcttcctgaacacagattgttttcttctcattcactaactatatcctgtcattggcttttactcctgctagcttctgatgcttctaccttaa

SEQ ID NO: 345813 - DNA, 673 bp, Homo sapiens
ggttctgtgggagaatgccctggtctgtattccaagggtaatggagtagcaggttgacaaattactttcaaatggttcaaaaaagaaagttcttttcactgtacttgcaattcttatgtaagctggaaattatctcaaaattaacgagaattttttatcgacgtagtattttacatatttatggaaaacatgtaagtatttgttacatgcataaactgtgtaatgaccaagtcagagtatctggggtatccatgaccttgagtattaatcatttgtatgtgttgggagcattacaagttttcgagttaccaatttttttttttttcctttgagacagggtcttactctgtcgcccaggctggagtgcagtgggacgaccacggctcacgcagcacagcctccacctcccaggctcaagcgatccttccacctcaaccacccaagtagctgggactacaggtgtgtgctgccacccccagctaattttttaatttttttgtagagacagggtctcactatgctgccagggctggtactgaactcctaggctcaagagatcctcccacctcggtctcccaaagtgctgggatcataggcatgagccaccatacccagccaaattttttaaagttattttttaaatctccacttaattcgattttggtaaaacacg

SEQ ID NO: 345814 - DNA, 659 bp, Homo sapiens
ttgaaaataactgatatcaaaaattcactaagaggggttcagtagcagatttgagcaggcagaagaaagaatcaccaaatttgaagatagatcaactgagattattcagtctaaggagcagaaaaagaaaagagtgaagaaaactgaacagagcctaggagacctgtgggataccctcaagcataccaacatacacagaatgggagtcccagaaagagaagagagaaagaaaggagcagaaagaatatttgaagaaatattgtcttataaggtctgggctataaagaaaaaaatacttgaagaaataatggttgaaaactcctcaaaagtgataaagacatgaatgcacatctaagaagctcgacaaactccacataaaataaacctaaagagatccacactcaaacagattataaccaaattgttgacaaagaaacatagaaaatattgagtgcagcaagagggaagcagctcactacatataagtgatccttaataagattattccctgatttatcagaatgagggatgatgtatagtaaccctgaaagaaaaacaattgttaatcaagaatcctgtattcaataaaattctccaccaaaactgaaagaaggccaggcacagtggctcacacctgtaatcccactgtaatctcagca

SEQ ID NO: 345815 - DNA, 335 bp, Homo sapiens
aaaatttttttaaaaagaaactgtctttgaagaagcccagatatttgacttactaaacagagactttcaatcaactgtcttaaatatgctcaaagacacaaagaaagtgaaggacaaagaactaaagaaaatcaagagaacaatgttttacctaatagaagacatcaataaaaatatagaaatgataaaaaagggaaccaaatagaaaacctggagttgaaaataactgatatcaaaaattcactaagaggggttcagtagcagatttgagcaggcagaagaaagaatcaccaaatttgaagatagatcaactgagattattcagtctaaggagc

SEQ ID NO: 345816 - DNA, 314 bp, Homo sapiens
aatttctgttatttttaccacccagtctgtgatcatttgttacggcacgtctagcaaactaatgtagtcttccagtaggctttatctaataataacacccccttcccatttagcatggaagcctgaatcaaaggggttgttgagctcatcctgttcatttaaatgtagcacgatccattgagaaatgaacacagataccatcctcaggcaaaagcatgtgcttagaaatgccatctggcagtcctcctgatatccccactctaataagaaaagtaagtcaggctcttagatgcaatcaacaggtgactaagaaa

SEQ ID NO: 345817 - DNA, 845 bp, Homo sapiens
aggagagggggaagaaaggagtgttttttaggtaaaagtatatagaggtgggactcaactcttaccggtattcaaatcacaaagggtttttcagctttccaacaagtctgtgaatggagtgggtgggattccagttgctcccatttgtgagagggaaagctaaggaccagagaaggtacgtggcttgctcaaggtcacacagcaagtcactgatggagcccaggcttccacatgtctgccctatgcggcttttcagggtatttacagagcagatgacatggagtaatgagcacggggctgggtggtccgggaccctcactgccaaggcttgaatgcagcctgcggcttgtccctttgcctgggcggctccctacagaccaatctggggagaggggcagggagtggtgtccctttaagacttggaggctttcaaatgttttgacctctatccaaaacaagaaatatatatttctattgctatccatatctgtaactgaaaccaaaattttacaaagcagcatatatctttactacatgcaatatattctgatatattctacttatttaggaaaaaaaaaaaaaagcagttgccacccactaaattgatttcatgatcctctcttgggtctggatccacggtttgaaacagtgctctaaatggcatctttgcaattgattatggacaattaagtacttagaagaaggaatatcaagccaatcagaaattaagagaaagctgatttgaaattatgattgaaatgggatatgtatgagtatgtgtgctttaaattttttattatgtagcagaaaaagctaatatcttgagttgtagggactcatgtggg

SEQ ID NO: 345818 - DNA, 207 bp, Homo sapiens
cacatacgatgaatgcacagctcgtaggtatacagtttaacgacttatgacagtggtataaccacaagaccagcaacatttgaatctttccatcaccctagacagtttgccctgtgtcccattccagttaaattacctttcctacacacacaaaggcaactactgttctgatttttgacaccagagcttagaccaactattatttaa

SEQ ID NO: 345819 - DNA, 753 bp, Homo sapiens
cattaacttttcatgacacgtcatggaacctcattccctatctgcaagcatccaagcaggtaatccaaaacctacatacagatctatcataggtcccgttcgtttctctttcaacttgacagcaagcttcctttaatctgcgagtatcaaaaagacatttcttggctttagttttttttttttcccttgacccacagaagacaaaatgacttaggtgtcctctttaaaaaaaaaaaaaacaaaattctcacaaatgcccaggtttttataggagggcaatggacccggcgagctcttaaacaactcctccaagacacaactcaaaaagagaactaataaatgttcagttgcttctcaccatctactcattcccctcaatcccacgcagtcccgaaaagcatccatattacctgaaacctggcggggaggatggaaggagagagacccaacaagctcaggatttacaagtaaagctggtttctaccccgaagatcctgacagctccgcagagtgcgggcgcagggtctgacagtgccctctagaagggctctcccaccccatcccctccccttagagacaagtcctccttcaaaagtcactgcctccgagagaagataccccttcacaccgccccaggcccctcggcaggcttcctcagcacccgccccgcagtcaggccctctaacctgacccggtccaggcccgggcggctcacccctccggcccgacccctcccccgcgcggccgcccctc

SEQ ID NO: 345820 - DNA, 694 bp, Homo sapiens
cattaacttttcatgacacgtcatggaacctcattccctatctgcaagcatccaagcaggtaatccaaaacctacatacagatctatcataggtcccgttcgtttctctttcaacttgacagcaagcttcctttaatctgcgagtatcaaaaagacatttcttggctttagttttttttttttcccttgacccacagaagacaaaatgacttaggtgtcctctttaaaaagagctcttaaacaactcctccaagacacaactcaaaaagagaactaataaatgttcagttgcttctcaccatctactcattcccctcaatcccacgcagtcccgaaaagcatccatattacctgaaacctggcggggaggatggaaggagagagacccaacaagctcaggatttacaagtaaagctggtttctaccccgaagatcctgacagctccgcagagtgcgggcgcagggtctgacagtgccctctagaagggctctcccaccccatcccctccccttagagacaagtcctccttcaaaagtcactgcctccgagagaagataccccttcacaccgccccaggcccctcggcaggcttcctcagcacccgccccgcagtcaggccctctaacctgacccggtccaggcccgggcggctcacccctccggcccgacccctcccccgcgcggccgcccctc

SEQ ID NO: 345821 - DNA, 783 bp, Homo sapiens
tatttgatgccagatgtatgactgtgggctgatgaggaagaactggaaacaaatgacaggtgattcactgctttgtgtctggtgtgccatgactctcttgaaggggggcagtgttgatctgaatctttttgtctaatgctttttcttcctctgggagggatgctgaagaggggcagctgaaggagcagtcttaagcaaattggtcatggctttcttaaatattgtgattcgattgatatggaacattttttcagtctgtgagagacttttcattatggactagctcataaaaaaccgtagatttaatttgcccaggctgttggttctcttgtgtttgttatcatacgtcagcatgaaacctttggcctttgtggaagccttgtggagaccactgaacagacttggagccatatctgactcgcctgccagcattcctgatgttcagtgcctgttattgcccctctccatggcattctcctctgtggttatgtgaaaggaaaataaatcactaagccaagggaaaaatcaaactgggagctatgtcaggcaaacctgcctcccattttattcctaaataacatagctacatacctccctcgcaatttgccacagatcctcgtcccacaaggaaattcactgtgggacaaaggacagacagaactcaaagtcatccctctgagactcacctgagacaaatgcatatctgattgcttcctttgccctattgtttatgtaaaaatgcagattcactgagtcagactaagttgtgtattgagtggaagg

SEQ ID NO: 345822 - DNA, 260 bp, Homo sapiens
aataaagaaaatagattccatggaatcaatgaattgatttgctttactaaagagagatcttgactgattgaaatttaactgttaaattagagtttttttgttatgtaaaatgaactgtgtgaggaatctaaacacttatttttttgttctttctttgtcgttgatagaagaatatttcagtcctgatatttgctgtaactaataattactggataaacagagaagacacatggaggatattttacctgggtccaacaaaa

SEQ ID NO: 345823 - DNA, 647 bp, Homo sapiens
gctaatagctaacgtattgtacagaacagatctagactaaaacgtgttgtgaaaaagaattaaaaagacatttctgtgcattatcataagtctacagattattaaaagacggaaatatatttaaggtttaatttttctatctggctccctcattatatgaatagaaatactaaaaatcagcaaagttagatgattctctggaaatcattcagttaatcagagtggcagaatcaagacaacaatcctgttaggatgggaaaaaatcaaatatccaatcaaatgggcttaaacaataccttggatgatcttgatacctaacataacaagattcccatgttggttgcttcagaatctcaacagggccatcaaaagttccagttttttccatcctgctctgccatcctctgtgtgtcagctttgccctcagttggccccttcctggttgcaagatggctgtttctatcctggaaaaaaacctccagcaagaaggatgtatggaagaagaaaagagcagtctctttacatgcctttttcttaagagagagaaaactttttccagaagccctcaacagtagaatccttcttttatcttaatgaccagaaatggagttctgcttatccttaaaccaatcactggcaagacaaat

SEQ ID NO: 345824 - DNA, 191 bp, Homo sapiens
tgccggatagaatgtttctgagacctgctctctaatattctaactcagtaggccctacgcagggcctgagaatgtgcattttcagtaagtgccactgctgatgttgatcagttctctaagaaattctgggttagctatgggattataagcatatcctcagagtacaggtttttttttttttgttttttttt

SEQ ID NO: 345825 - DNA, 283 bp, Homo sapiens
acacattactttttccatttattgaaattttatggaaaaacttccctataaatcagaaaaaagggagagctcctctagctaagtccagggtggaagaccaagagcatttccttcccagtggaagctcttcattcaatggaattgcaaaatatatttacaagtcactgctacaaacatatggaacttagaaagcccactgtggcccccattaactgcgttaccaagagagatatgcaattaatactgaatccctcttaataatagccagggatattggtttaag

SEQ ID NO: 345826 - DNA, 573 bp, Homo sapiens
ctgagcgtgatggtttgcacctgtaatcccagctacttaggaggctgaggtgggaggatcgcttgagctctggaggtggaggctgcagtgatcagtgatcgcaccactgcactccagcctgggtgacagagcaagaccctgtctcaaaaaaaagaaaaaggtacaagtcgtagtagagaaaactgtgaggttcagagcagactgtgtgtaattatgaatgtgtgtttcgtggatctttaatctatggtgatggaggcctagacttaaagtgggttctcccgaagcgggcattacctgggttcattaccaagctgcattaatgtcagttttcaacttagggtttggactccacacatgctctgagttctggctgtttgtggttcagaaatttccaggatgactttttttctttgtttttctccctgaggccagatccaaggcagttttaacttttaaaaagtgcacttgctgaatccaaaggtgattttaggacttttaacttgtgctgccaaattgaattgctatcctcaactatttgaatatttccaaagatctagtactttttcttacact

SEQ ID NO: 345827 - DNA, 1439 bp, Homo sapiens
aagacttgccaatactagccaatcaaatccttccttcaattttagaaaacaggaattgcatgtaaacaagtctgggccaactcttacaacctgctttctatatcctcctcctctgttctccatctttcctagttctttcagccccagtggtcaggctgagctgagtatgagaaagggccctcaagaggccctggaagcatattccctcagctcctaaatgaagtctccataaggtgaccctaggagactgtgcagcatgactggccgcttgttttatcccagactcttttccagggtcttacttctgtcatccagactggagtgcagcagtgcgatctcagctcactgcaacctccacctcccaggtttaagcgactctcctgcctcagcctccacaataactgggaccacaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcaataggatcacgagaccattcaaatctctccattccttcaagagctcctcttcctgctgacacaactggtattggggatttcttaccattgaaagctgaacttgatactacttacactttcttaaaggagacatttataaatactgtgccccatgctctgacatcatctcactcctctccagtgactatgtctgctaatgccaacagaccaactcagattggattatgacttcatgaaattaaaaaatggaggaagagttaacagtacaattaaaattgttttgaatgggaattttcttatcagttgacttttgtttcagcagaagtggcagtggatttaaaaaatttgtgcgctatcttgatgtattctggtagctctgtctccttgaataaggaaatagccaacttttttctctccaagttttatttgttatcacagttgctcatttttatgtaacatatttttaaatgttaaggaatgacacattttgggtaatttccctcagacttaaaaaaatcaataagccattttagtctctatctatcaaagttgtttcatacttgtctattttaaagcaggactgcaatgctttaataggattgagagagctatttgaaatgtatgccaatgattcctgtcatttcatggcagcccggccatggttcactgagccccctcttctctcttgtcagctcaactgaagacaagcatttagttgcaaactttaagcaggttgtgcaaaacagaaatgatgtgactgcttctcctcctgcacaataatgtcactcctggtcaatgtgagaaggtcaggttgctccttgtaaagctacatgataccacttgcccatttgaacaagttaagttaactgctga

SEQ ID NO: 345828 - DNA, 802 bp, Homo sapiens
atatttgaagcacagtgtggatgttaatgtgtggctaaactgagcaagaagaaaacattatgtagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtctaaataacattgtttgctactgagacatatagaaaaataaattgcactaactggagagaatgaaagcctcaaagtattgtgaataatttaaaggagatgcaaatagatgtttcttcatttttcttctatcatgtaacagtatactttacaaaatactgtttttttctttaaagcctagaactagcctattaaaataatccagaaaagtgtttttaccaaggaaaaatgtgttttatggcaaagtacagtattaaaagaaaatactttcctatcagcagaggacaataagacactaggctgttacctctttaagcaagtctcaatttgttgcttttattgtttgaaaataagtaattttagaaaaaaaataaaataataaatcactttagttgtaaac

SEQ ID NO: 345829 - DNA, 833 bp, Homo sapiens
  misc_feature (7)..(7): n is a, c, g, or t
  misc_feature (14)..(15): n is a, c, g, or t
  misc_feature (40)..(40): n is a, c, g, or t
  misc_feature (47)..(47): n is a, c, g, or t
agcgggnagactgnncacgcatactggccgtcgtttacancgaatcntgccaggtcttacttctgtcatccagactggagtgcagcagtgcgatctcagctcactgcaacctccacctcccaggtttaagcgactctcctgcctcagcctccacaataactgggaccacaggtgtgtgccacaacacctggctaatttttgtattttttttatggagacagagttttactgtgttggccagggtggtctcgaacttctaacgtcaaatgatccacctgcctcggcctcccaaagtactgggattacagcccacatttctaaaataggaaaaatcctgaactgagaaacacattggttccaagggtttcagataaaggaatgtgagaattgtactagcattataaaacaggttctatgcaaaggacatatactgttgtttccatgcattgtgtcaatgcaatcaaacaaaggttttttgcttatagagaagcacattcagtctgtgggatggtatatttgagtgaatttttgctatctactctctcttgcatcttgttttgagtcataaaggaattgtgtagtattttatgccacttgaaaactcgaaagacttcaacagttgtgttatgtgcaaatcagataaggctctaataggctttatcttgcttgtgtatagtacctgtttgcaaactaaaggcacatttttactccatgccagtaggaatcctctgaggcattattttttgggcccctcccactttatgtactgaaagcagaatggatgaaatgccttgacacataacttacttatcttttcttactcaacattctaa

SEQ ID NO: 345830 - DNA, 679 bp, Homo sapiens
  misc_feature (89)..(89): n is a, c, g, or t
gtgtttatgtaaggtgatttatattaaatttcgcacttctttactatctgcctcacccacacaagacaagctccactaattccaactgnaaaagtatgaggatgaagacttttatgatgatccacttccacttaatgaatagtcagagatcagatctcgctgtcatggtctgcggcaagtaggaatgacttcaccctacagctacccaaactgcacctggagacctttgcaatggaggggctcaagggcgggccagaggtggtagcatgccaggttagagtctaaataacattgtttgctactgagacatatagaaaaataaattgcactaactggagagaatgaaagcctcaaagtattgtgaataatttaaaggagatgcaaatagatgtttcttcatttttcttctatcatgtaacagtatactttacaaaatactgtttttttctttaaagcctagaactagcctattaaaataatccagaaaagtgtttttaccaaggaaaaatgtgttttatggcaaagtacagtattaaaagaaaatactttcctatcagcagaggacaataagacactaggctgttacctctttaagcaagtctcaatttgttgcttttattgtttgaaaataagtaattttagaaaaaaaataaaataataaatcactttagttgtaaac

SEQ ID NO: 345831 - DNA, 1244 bp, Homo sapiens
cccagttggagaaaaaaagagttagatagcagctaacttggggaatgaacttcgacgtcagggaaaaaccatcaccaatatgaaatgtcagagatcagatctcgctgtcatggtctgcggcaagtaggaatgacttcaccctacagctacccaaactgcacctggagacctttgcaatggaggggctcaagggcgggccagaggtggtagcatgccaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcaataggatcacgagaccattcaaatctctccattccttcaagagctcctcttcctgctgacacaactggtattggggatttcttaccattgaaagctgaacttgatactacttacactttcttaaaggagacatttataaatactgtgccccatgctctgacatcatctcactcctctccagtgactatgtctgctaatgccaacagaccaactcagattggattatgacttcatgaaattaaaaaatggaggaagagttaacagtacaattaaaattgttttgaatgggaattttcttatcagttgacttttgtttcagcagaagtggcagtggatttaaaaaatttgtgcgctatcttgatgtattctggtagctctgtctccttgaataaggaaatagccaacttttttctctccaagttttatttgttatcacagttgctcatttttatgtaacatatttttaaatgttaaggaatgacacattttgggtaatttccctcagacttaaaaaaatcaataagccattttagtctctatctatcaaagttgtttcatacttgtctattttaaagcaggactgcaatgctttaataggattgagagagctatttgaaatgtatgccaatgattcctgtcatttcatggcagcccggccatggttcactgagccccctcttctctcttgtcagctcaactgaagacaagcatttagttgcaaactttaagcaggttgtgcaaaacagaaatgatgtgactgcttctcctcctgcacaataatgtcactcctggtcaatgtgagaaggtcaggttgctccttgtaaagctacatgataccacttgcccatttgaacaagttaagttaactgctga

SEQ ID NO: 345832 - DNA, 1377 bp, Homo sapiens
ctcctggagtttgctgggattccactccagaccctgtttgcctaggtatcaccaacagaggctgcagaacagcaaagattgctgcctgctccttcctctggaagcttcgtcccagagggacacctgccagataccagccggagctcttgtatatgaggcgtctgtcaacccctgctgggagttgtctccctgtcaggatgcatgggggtcagggacccccttgaggaggcagtctgtcccttagcagagctcgagtgctgtgctgggagatctgctgctctcttcagagctgacaggcaggaacgtttaagtctgctgaagctgtgcccacagctgccccccttcccccaggctatgattaaaagtttcatggatgtctaccagcttgcaagcactagaatcatgacattagagaaggaaatgacatctcatcgaagtcacattgcagccttgaaatcagaacttcacacagcttgtttacgtgaaaatgcaagtttacaatcaataggatcacgagaccattcaaatctctccattccttcaagagctcctcttcctgctgacacaactggtattggggatttcttaccattgaaagctgaacttgatactacttacactttcttaaaggagacatttataaatactgtgccccatgctctgacatcatctcactcctctccagtgactatgtctgctaatgccaacagaccaactcagattggattatgacttcatgaaattaaaaaatggaggaagagttaacagtacaattaaaattgttttgaatgggaattttcttatcagttgacttttgtttcagcagaagtggcagtggatttaaaaaatttgtgcgctatcttgatgtattctggtagctctgtctccttgaataaggaaatagccaacttttttctctccaagttttatttgttatcacagttgctcatttttatgtaacatatttttaaatgttaaggaatgacacattttgggtaatttccctcagacttaaaaaaatcaataagccattttagtctctatctatcaaagttgtttcatacttgtctattttaaagcaggactgcaatgctttaataggattgagagagctatttgaaatgtatgccaatgattcctgtcatttcatggcagcccggccatggttcactgagccccctcttctctcttgtcagctcaactgaagacaagcatttagttgcaaactttaagcaggttgtgcaaaacagaaatgatgtgactgcttctcctcctgcacaataatgtcactcctggtcaatgtgagaaggtcaggttgctccttgtaaagctacatgataccacttgcccatttgaacaagttaagttaactgctga

SEQ ID NO: 345833 - DNA, 477 bp, Homo sapiens
atatttgaagcacagtgtggatgttaatgtgtggctaaactgagcaagaagaaaacattatgtagtctctccgaggcaaagatggagctgagaagaaaagatcaatctctgcgtcagctcaatagacatcttacccagctggagcaggacaagcgtcgactggaggagaacatccatgatgcagagagtgccctccgcatggcagccaaagacaaagaatgtgttgctaatcacatgagagcagtagaaaatacgcttcacaaggtcagagatcagatctcgctgtcatggtctgcggcaagtaggaatgacttcaccctacagctacccaaactgcacctggagacctttgcaatggaggggctcaagggcgggccagaggtggtagcatgccaggttagagtctaaataacattgtttgctactgagacatatagaaaaataaattccagatgcggccggaattctcccctcggg

SEQ ID NO: 345834 - DNA, 533 bp, Homo sapiens
aaaacagccatcgatttacagaactatcaagaactgagccaggtgcattatatgcctttctccttttatcctcacaacaacagcacgggtagctattacctgcacataacagctatggaaatcaggcttaaaaaagttaactcatttacaaaggtcatacaatgaagaggtagcagaaataagatgagatgccagggctgatgccaagactaacgttcattaaactctacctcattatgcttattcatcgatagtccagatgcatcaattcatttgaatagaaaaactgtcatgtataccatatacagaataacaattgagcacaatataaacttatttggataattgagaagataaatcaagatcttatgatgcttgagtgtactagacgaaactgttgcagaccaaaaccatgtctttttttttcttcatacccttagtatctttgttcagtgctaggtatgtaacaagcattcaataaatattgaatgagtatttttgaagtaaataaatcatcccaataccaggaacaa

SEQ ID NO: 345835 - DNA, 178 bp, Homo sapiens
tacgagacagtcttgttctgttacccaggctggagtgcagtgcaatcctacggagaatttctagcccattagaagaacacatccatgaccccccttctcctttacctgccatatgcaactgattgccagattttgctgctttcacattaaagttaaccctcgcctttgccccttctgt

SEQ ID NO: 345836 - DNA, 1229 bp, Homo sapiens
acagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaattcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttaaaatacctgaagataacag

SEQ ID NO: 345837 - DNA, 584 bp, Homo sapiens
tttttaatactatttctaatatagggtgatggattggagttcaagagacacttcctgaagattaaagggaagctgattgaaaggtttggcttcctgccacatgatcggaccatcggctctggggaatcctggtgaatatagtgctgctatgttgacattatatcctgtcctgcaaactgcaaatagtagttcctgaagtgttcacttccctgtttatccaaacatcttccaatttattttgtttatacctatatcttaattgtaagcaaaactttggggaaaggatgaatagaattcatttgattatttcttcatgtgtgtttagtatctgaggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacc

SEQ ID NO: 345838 - DNA, 2799 bp, Homo sapiens
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 345839 - DNA, 3424 bp, Homo sapiens
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggagttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaattcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttaaaatacctgaagataacag

SEQ ID NO: 345840 - DNA, 3369 bp, Homo sapiens
  misc_feature (2932)..(2932): n is a, c, g, or t
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggagttgaggccttggctcctgcctgtagtcccagctacttaggaggctgagagaggaggatcgcgtgaacctggaagtttgaggctgtagtgagctatgattgcaccagtgcactccagcttggatgacagaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaaaanaaaaaaaaagaaaaaaaaaaaaaagggggggggcgcgcccacaaaaatccccccgggggggcccccacaagggagcgcgaccgcccggttttgtgtggagaaaggggggcccccactaggggggggcgctataaaggagggggcggggggggcgcggggtgttaaaaaaaaggccgtgtatggagcgggtgggaaaaaaattgcgtattatggtggaaacactcctttggtggaaagaaagacccaccatcaaattcggggggggggggagaacaaattggtggggaccacacaatcctcccctaagaaagttattaaaccccccagtggagagacaataaaccatttgacgggttactaattgtttgttacacaacgctctaattctctcgcaataaaaactctcgtccagggatgtattgaagacatattttccc

SEQ ID NO: 345841 - DNA, 2687 bp, Homo sapiens
  misc_feature (2513)..(2513): n is a, c, g, or t
  misc_feature (2531)..(2531): n is a, c, g, or t
  misc_feature (2543)..(2543): n is a, c, g, or t
  misc_feature (2545)..(2545): n is a, c, g, or t
  misc_feature (2561)..(2561): n is a, c, g, or t
  misc_feature (2563)..(2563): n is a, c, g, or t
  misc_feature (2583)..(2583): n is a, c, g, or t
  misc_feature (2611)..(2611): n is a, c, g, or t
  misc_feature (2621)..(2621): n is a, c, g, or t
  misc_feature (2623)..(2623): n is a, c, g, or t
  misc_feature (2660)..(2660): n is a, c, g, or t
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggacgcctctgcgcgcgcaatcctgcgcttgagcgcgttgcgctntttgctttgctagcttanagcttaatttgncncgcgctgcagcagagngnggcattgcgctgcaatttgncaagctttgcaggctgctagctgagctnatgcattgcnanaagctgcaatttaagctttgcgcatgcaaagcaatgncagctttttattttttgctttttttag

SEQ ID NO: 345842 - DNA, 2219 bp, Homo sapiens
gagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacc

SEQ ID NO: 345843 - DNA, 2062 bp, Homo sapiens
gagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaagccgaggtgctcggtggagtcatggcagtgccctttgtggaagactgggacttggtgcaaaccctgggagaaggtgcctatggagaagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacc

SEQ ID NO: 345844 - DNA, 520 bp, Homo sapiens
gtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaata

SEQ ID NO: 345845 - DNA, 2981 bp, Homo sapiens
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacc

SEQ ID NO: 345846 - DNA, 2575 bp, Homo sapiens
  misc_feature (145)..(145): n is a, c, g, or t
  misc_feature (189)..(189): n is a, c, g, or t
  misc_feature (206)..(206): n is a, c, g, or t
  misc_feature (213)..(213): n is a, c, g, or t
agtgaggaaactcttggggccccagcggcgccccccccaaaggttccccttggctgtttgccgtgggaataaggtgccccgcctttgggcgtttcccggggccctttggccgccccccgtataaaccccaccttttcccaacaangttcgggtctcttcaagcaagctgctcgctggtttcttcggggncttcctcaaggcccaancccacanggaggtttacccgcaacttctgaggtttacaaagcactctgcttcaccgactgtgatcctcacagtcctgtccggtggcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacc

SEQ ID NO: 345847 - DNA, 2929 bp, Homo sapiens
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggagttgaggccttggctcctgcctgtagtcccagctacttaggaggctgagagaggaggatcgcgtgaacctggaagtttgaggctgtagtgagctatgattgcaccagtgcactccagcttggatgacagaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 345848 - DNA, 3287 bp, Homo sapiens
  misc_feature (2850)..(2850): n is a, c, g, or t
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaaaaaaaagaaaaaaacaagaaagaaaaagaagaaaaaaaagaaaaaaaaaanaaaaaaaaagaaaaaaaaaaaaaagggggggggcgcgcccacaaaaatccccccgggggggcccccacaagggagcgcgaccgcccggttttgtgtggagaaaggggggcccccactaggggggggcgctataaaggagggggcggggggggcgcggggtgttaaaaaaaaggccgtgtatggagcgggtgggaaaaaaattgcgtattatggtggaaacactcctttggtggaaagaaagacccaccatcaaattcggggggggggggagaacaaattggtggggaccacacaatcctcccctaagaaagttattaaaccccccagtggagagacaataaaccatttgacgggttactaattgtttgttacacaacgctctaattctctcgcaataaaaactctcgtccagggatgtattgaagacatattttccc

SEQ ID NO: 345849 - DNA, 2757 bp, Homo sapiens
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacc

SEQ ID NO: 345850 - DNA, 1878 bp, Homo sapiens
ttttccctctcctctcttggggccccttgtgtccacgaaccctggtgcccgctacctgtgggccccccctgggggttctcttatgggcgcgtccccccctttttcttctctctcttttctcgctctcttttatgccgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagcctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagt

SEQ ID NO: 345851 - DNA, 402 bp, Homo sapiens
caggcatgagtctccatgctcagccaaaattacatctgtattttcactaacttttaacagaaatttagcatctcctttaattatgaatgtaggcaacaaatcactggtactggcagtaactgcaatgttattactaatagaaataacagatattttcattttacattacaagtgttgaagatacatctaaatattgtttgcattcagcacactttgtaattataattgatattagacttgctgttagatctttaatacattgataaaaatcagttacatcataaacattttaatattttgataattatatgtgaatataattgtttttctttatgaacccctgtgttttttgcaaatttaaaaaatgtttatttattttctttttttggaggccagagtttg

SEQ ID NO: 345852 - DNA, 1722 bp, Homo sapiens
acaaacaggaggtcggaaggaagcatgtgggggtagatctggaggtgacaagggagggatccttctgggataatgggtcttcagagactgtttcagtttagactccagtgaccccagaactagtgtgattggggttcttgtctccaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345853 - DNA, 2695 bp, Homo sapiens
ctccagcctgggcaacagaacgagactccatctcaaaaactagcaaacaaacaaaacaaacaaacaacaacaacaacaaaacttcagagttttgcattcttggcatgctcagaaaaaaatgttcagggggatcacagggactttttgtaatcaatttataacaatgaagatgaatcaagataatatttattgagaactcatcatatgacagaaatgatgtaatatgcctattccatggtgtatgtggtctcatttaatttacaccgccttgtgaagtagaggatattttccaccctctcccccatgccatgacaaatggtgaaactgagggccagagaggttagagagatttcccaagttcacccagcttgtcagtgagtctaagagtgggggaaaaggggttctagcctggctccctggcatcaaagcaggtcatcttgattgctattgaggatttgacaggtgagacctagaggagggctgtgagttgaccaagggtacacacagcttaggaatcacagctggggcttgaacccagccatgggatcttcatctcctaatagtaacagcttccactctcacccaagcgtagtcctccctgaggatgggggtctgggacagaaaaccaggagcatgcctctgggggagtccatcctggtggttggggttgcagggggactcagaggagccaaggcctggccccagccctgctcccttctctggccaggccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345854 - DNA, 2547 bp, Homo sapiens
ctccagcctgggcaacagaacgagactccatctcaaaaactagcaaacaaacaaaacaaacaaacaacaacaacaacaaaacttcagagttttgcattcttggcatgctcagaaaaaaatgttcagggggatcacagggactttttgtaatcaatttataacaatgaagatgaatcaagataatatttattgagaactcatcatatgacagaaatgatgtaatatgcctattccatggtgtatgtggtctcatttaatttacaccgccttgtgaagtagaggatattttccaccctctcccccatgccatgacaaatggtgaaactgagggccagagaggttagagagatttcccaagttcacccagcttgtcagtgagtctaagagtgggggaaaaggggttctagcctggctccctggcatcaaagcaggtcatcttgattgctattgaggatttgacaggtgagacctagaggagggctgtgagttgaccaagggtacacacagcttaggaatcacagctggggcttgaacccagccatgggatcttcatctcctaatagtaacagcttccactctcacccaagcgtagtcctccctgaggatgggggtctgggacagaaaaccaggagcatgcctctgggggagtccatcctggtggttggggttgcagggggactcagaggagccaaggcctggccccagccctgctcccttctctggccaggccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345855 - DNA, 2137 bp, Homo sapiens
ggaggtctgagtttggtggagaaaatggggcagatttgggagaaactgagtaataataggcaggagcagatgttttataagacagagagaggagatgcccatgatggccaagctgtgccctggggacctggggcaggaggcagctcacagagagtgggaggcagagagtgaagtgcgcttgcaggacacccctttctgcatggaatgtggtcctgggattctggctggaaggtgctcccaggctttcatgtgggtaaggagctgcttcctctctctggactggccctgcaggaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345856 - DNA, 1643 bp, Homo sapiens
aggggttggcagttaactagatcttaaggatcttgaaaagtcagacaaagggagatgcattttatccaaggttcctaaggagccatggaggtgtttgagcagatgagagacatggtcagtactgagcttggacactggactctatgggactctatggaagattgactgtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345857 - DNA, 1347 bp, Homo sapiens
ctccagcctgggcaacagaacgagactccatctcaaaaactagcaaacaaacaaaacaaacaaacaacaacaacaacaaaacttcagagttttgcattcttggcatgctcagaaaaaaatgttcagggggatcacagggactttttgtaatcaatttataacaatgaagatgaatcaagataatatttattgagaactcatcatatgacagaaatgatgtaatatgcctattccatggtgtatgtggtctcatttaatttacaccgccttgtgaagtagaggatattttccaccctctcccccatgccatgacaaatggtgaaactgagggccagagaggttagagagatttcccaagttcacccagcttgtcagtgagtctaagagtgggggaaaaggggttctagcctggctccctggcatcaaagcaggtcatcttgattgctattgaggatttgacaggtgagacctagaggagggctgtgagttgaccaagggtacacacagcttaggaatcacagctggggcttgaacccagccatgggatcttcatctcctaatagtaacagcttccactctcacccaagcgtagtcctccctgaggatgggggtctgggacagaaaaccaggagcatgcctctgggggagtccatcctggtggttggggttgcagggggactcagaggagccaaggcctggccccagccctgctcccttctctggccaggccaagtggcaacgcctggccatggagggcagcacctgtctggatgtgtttgagcacatcagccttatgaccctggacagtctgcagaaatgcatcttcagctttgacagcaattgtcaggagtgagttcttgcccagggcctgggaacatgggatggagtgggggtgtgggtgtggggagagcaaagcccagggagacaagaagagccttcctggagagatgatgagaactaggcattgaaggacaaagaaggagagaaggagagagagagagagcgagagaaagagaagtttcctccaaacaagtggaactgtttgggtcaaggcaaggaggctaagatgaacagacatgtgtatccaatgcatacctcccacttataagtgagaacatgcaatattttgttttctgttcctgcattagtttgcttaggataatggcccccagctgcatctatgttgctgcaaacgacatgattttgtactttttaatgactgcatagtatttcatggtgtatttctacacattttctttatccactccaccattgatgggcacctgtgttgattcagcatcttcgctattgtgattagagctgcgataaacatgtggatgcttgtgt

SEQ ID NO: 345858 - DNA, 2500 bp, Homo sapiens
cagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggggatgggctcttgttaagtgttggtgacaagtggagacaccaccgtcgcttgctgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345859 - DNA, 1080 bp, Homo sapiens
ggaggtctgagtttggtggagaaaatggggcagatttgggagaaactgagtaataataggcaggagcagatgttttataagacagagagaggagatgcccatgatggccaagctgtgccctggggacctggggcaggaggcagctcacagagagtgggaggcagagagtgaagtgcgcttgcaggacacccctttctgcatggaatgtggtcctgggattctggctggaaggtgctcccaggctttcatgtgggtaaggagctgcttcctctctctggactggccctgcaggaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgagctattgaccctttccgcttccgaccccgaaaacgccaggaagaggtcactatggtcttattcctatttcgggggccccacggacactgcattgggacaaattccggaaggcgacataacgtg

SEQ ID NO: 345860 - DNA, 2630 bp, Homo sapiens
ctccagcctgggcaacagaacgagactccatctcaaaaactagcaaacaaacaaaacaaacaaacaacaacaacaacaaaacttcagagttttgcattcttggcatgctcagaaaaaaatgttcagggggatcacagggactttttgtaatcaatttataacaatgaagatgaatcaagataatatttattgagaactcatcatatgacagaaatgatgtaatatgcctattccatggtgtatgtggtctcatttaatttacaccgccttgtgaagtagaggatattttccaccctctcccccatgccatgacaaatggtgaaactgagggccagagaggttagagagatttcccaagttcacccagcttgtcagtgagtctaagagtgggggaaaaggggttctagcctggctccctggcatcaaagcaggtcatcttgattgctattgaggatttgacaggtgagacctagaggagggctgtgagttgaccaagggtacacacagcttaggaatcacagctggggcttgaacccagccatgggatcttcatctcctaatagtaacagcttccactctcacccaagcgtagtcctccctgaggatgggggtctgggacagaaaaccaggagcatgcctctgggggagtccatcctggtggttggggttgcagggggactcagaggagccaaggcctggccccagccctgctcccttctctggccaggccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345861 - DNA, 2451 bp, Homo sapiens
gtctttaactcttattctgtaaatgtgttttgtagagtgttgacttatgcttgggtgttgcagaacatgttggaccatgtaggagccatgtcaagacatgctgggtgtgctgtaccatgtcagggtgtatcattgctctatagtgttgttgcagcctagtccggtcccctttatgccccccaccctcctttcttcttctgcccatggcctccttcctgctatgctgggcttggagaaaagacgtccaaacctctggctgggagccaccctccatacccaaagtccctcctctattcctctccatggaccctgatggtcctcattcatgtcagatgccattacagacaaggacatagtcttctacaagaccctgaagccctggctgggtaagtaactgtaggtggacgggacggggaccaacttttgtggccaggggaagattctgcccttgcccacagcctttggctgccgtactaggggatgggctcttgttaagtgttggtgacaagtggagacaccaccgtcgcttgctgacgcctgccttccatttcaacatcctgaagccctatataaagattttcagcaagagtgcaaacatcatgcatgaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaattaccttttcagatttccggtaataaatctgtgttggcccctgtgcctgagtcccacggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaaataattgtgtattctgatataaatttttgccaatttagaatccctgttttttagctaggtgcatagcagcctgaaatacagatcacatttgaaagcctttcttgaagctcaattggttaagtgactgtggctgtcccatgtgtagaagccaaagattatgtggtaattctggtaacctttcttaagagaaagctgctacagtctgtctgctcagtcctcccctcttccttcctgctgcttggaagatttttttttttttttgagacatggtgtctctcgtcgcccaggccggagtgcagtggctcactgcaacctccacctcctgggttcaagtgattctcctgactcagtcgcctgagtagataggataacaggcgcctaccaccacacccggctaattgtatttttagtacagatggggttttgctatgttggccaggctggtctcaaactcctggcctcaagtgatcagcccacctcagcctcccaaagtgccagaattgcaggtgtgagaataaaaattcttgagtttcaatgtttattttagaatcaggtgctaacatgcaaatttattacaaaggtatattgcatcatgctgaggtttggagtatgaatgactccatcacccatgtagtgagcatagtatctaa

SEQ ID NO: 345862 - DNA, 280 bp, Homo sapiens
agactttgagaggtactgtcatatcctccaccagcctttctgacttttcttttcgttccttccttcctttccttccttccttccgtctttatttctttgctttctttcttttcttctttctttctttcttcctttctctttctttcctttctctcttgctctttctgtctttcttttcttttctttttgagagggtcttgctctgtcacccagactggagtgtgcagtggtgccatcatggttcactgcagccttgacctcctgggctcaatggatcttc

SEQ ID NO: 345863 - DNA, 1552 bp, Homo sapiens
catcatttcccctatgcaattttaagttttgataatgaaataaaacacaatgcagaatgattttgctataggttagatgaccactgtacttgataattgaaaaatggtttatgttcttagacaagccaatgaagcaatctcctgctcttggaacaaacaaaaaccacatgattaacctctcacaagattgacgtgcactgtggtgtagaaagtttgtttgcctttccataacccagtgtatctaagaattacctcggaacttccatttctattaatattacctactaacacttaagtctgagtgtggtggctcatgcctgtaatcccagcactttgggtaaggctggtctcgaactctcgacctcaggtgatccacctgcctcggcctcccaaagtgttgggattacaggtgtgcgcccccacgcctggcctaaatgtttttaaactctcatcctgatcagtatttaggttatagataattttttaaaactctacttagaatattgtttcagaggagtctgtaaataacaaaactctataattgcagtcatagctgatgtatctatacttggatcttttccaaatgctcttctactcttgtaatttctagtctggtcagctggaaataaaagtatccagtaactccacttgtccatctaaaaatataattatttttttaactaacccattaagtattttttatatgtatttattagccaatcatgttatttactgtgactttcctgtttgtttcttttgctcattttctcaacctgctgatttatgaatacacacacatactctagatcttgattcttctgttattttatatataatatccttttcctggagagtagctgtttaaagtgcattcatgatttttctgatactgatagttttcccacatactatcatattatatttggatgttgccattatcactctaaccataaactggtaatctatttatatttttaatagtatgtgagatttctgtgtattcagtcagattatctatgaatggaaatgaattttcttttaaaatcattattatttctttacttttattaaaataaatacgattatgtcaagtattggggtaatagccagtgtcttagttgtttaaacagtttaatggaaatcagtacaatattttaccattcaactaatatttactttgttgtatgcaagtatgctctataattagggctaacttcttatattttttcaaatcctatcacttcttttgctttgttcatatatcattctcctctgctattttaatgttataattcattctgatttcttgttttaaaccatttctgaaatataatatgcttagctgtggtatattattgttttgataagctgcttaatttatcttatgaatattttgtttgggatttttgtccaaatattcaaaattgatattaatattattagcattcatatattaacattcaaaattaagaattttttaaatttttgttattgccattatttgtttattaaaggttagataaaatttggctttaaacccatatggtcctgt

SEQ ID NO: 345864 - DNA, 1583 bp, Homo sapiens
catcatttcccctatgcaattttaagttttgataatgaaataaaacacaatgcagaatgattttgctataggttagatgaccactgtacttgataattgaaaaatggtttatgttcttagacaagccaatgaagcaatctcctgctcttggaacaaacaaaaaccacatgattaacctctcacaagattgacgtgcactgtggtgtagaaagtttgtttgcctttccataacccagtgtatctaagaattacctcggaacttccatttctattaatattacctactaacacttaagtctgagtgtggtggctcatgcctgtaatcccagcactttgggtaaggccgaggtggtcggatcacttgaggtcaggagctggtctcgaactctcgacctcaggtgatccacctgcctcggcctcccaaagtgttgggattacaggtgtgcgcccccacgcctggcctaaatgtttttaaactctcatcctgatcagtatttaggttatagataattttttaaaactctacttagaatattgtttcagaggagtctgtaaataacaaaactctataattgcagtcatagctgatgtatctatacttggatcttttccaaatgctcttctactcttgtaatttctagtctggtcagctggaaataaaagtatccagtaactccacttgtccatctaaaaatataattatttttttaactaacccattaagtattttttatatgtatttattagccaatcatgttatttactgtgactttcctgtttgtttcttttgctcattttctcaacctgctgatttatgaatacacacacatactctagatcttgattcttctgttattttatatataatatccttttcctggagagtagctgtttaaagtgcattcatgatttttctgatactgatagttttcccacatactatcatattatatttggatgttgccattatcactctaaccataaactggtaatctatttatatttttaatagtatgtgagatttctgtgtattcagtcagattatctatgaatggaaatgaattttcttttaaaatcattattatttctttacttttattaaaataaatacgattatgtcaagtattggggtaatagccagtgtcttagttgtttaaacagtttaatggaaatcagtacaatattttaccattcaactaatatttactttgttgtatgcaagtatgctctataattagggctaacttcttatattttttcaaatcctatcacttcttttgctttgttcatatatcattctcctctgctattttaatgttataattcattctgatttcttgttttaaaccatttctgaaatataatatgcttagctgtggtatattattgttttgataagctgcttaatttatcttatgaatattttgtttgggatttttgtccaaatattcaaaattgatattaatattattagcattcatatattaacattcaaaattaagaattttttaaatttttgttattgccattatttgtttattaaaggttagataaaatttggctttaaacccatatggtcctgt

SEQ ID NO: 345865 - DNA, 1017 bp, Homo sapiens
catcatttcccctatgcaattttaagttttgataatgaaataaaacacaatgcagaatgattttgctataggttagatgaccactgtacttgataattgaaaaatggtttatgttcttagacaagccaatgaagcaatctcctgctcttggaacaaacaaaaaccacatgattaacctctcacaagattgacgtgcactgtggtgtagaaagtttgtttgcctttccataacccagtgtatctaagaattacctcggaacttccatttctattaatattacctactaacacttaagtctgagtgtggtggctcatgcctgtaatcccagcactttgggtaaggccgaggtggtcggatcacttgaggtcaggagttgaagaccagcctggccaacatggtgaaaccccatctctactaaaaatacaaaaatgagccaggtgtggtggcgcatgcctgtaatcccagctgctctggagcctgaggcaggagaatcacttgaacccggaggcataggctgcagtgagccgagattgtgccactgcattccagcctgggtgacagagtgagactctgtctcaaaaaaaaaaaaaaaaaaaaatcgggacatgaaaccataagctgaaatgctgccaagacctaaaggaatgaccctcaaactggaatttcagcattttgtcatgtgattaatccccgggagaatgcagtcagctcacatgatgataggcaagtaaccacctttttctgtactcgtactactgttacttttctacaaaatgaaaaacctaaatgtttttttgttttgttttgttttttgggttttttttgttgttgttgttgtttttgagacggagttttgctcttgttgcccaggctggagtgcaatggtccgatcttgactcactgcaacctctgcctcccaggagaatcacttgaacccggaggcataggctgcagtgagccgagattgtgccactgcattccagcctgggtgacagagtgagactctgtctcaaaaa

SEQ ID NO: 345866 - DNA, 518 bp, Homo sapiens
ctcactgcaacctctgcctcccaggttcaagcgattctcctgcctcagcctcctgagtagctgggattacaggcacgcatcaccacgcctgcctaattttttttatacttttagtagagacagggtttctccatgttggtcaggctggtctcgaactctcgacctcaggtgatccacctgcctcggcctcccaaagtgttgggattacaggtgtgcgcccccacgcctggcctaaatgtttttaaactctcatcctgatcagtatttaggttatagataattttttaaaactctacttagaatattgtttcagaggagtctgtaaataacaaaactctataattgcagtcatagctgatgtatctatacttggatcttttccaaatgctcttctactcttgtaatttctagtctggtcagctggaaataaaagtatccagtaactccacttgtccatctaaaaatataattatttttttaactaacccattaagtattttttatatgtatttattagc

SEQ ID NO: 345867 - DNA, 541 bp, Homo sapiens
ttcccacaaacccggaagcggatcgcgtggagtgaaggtcacgccgcggcgcgattgacttctaaagagtcatgctgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaacttta

SEQ ID NO: 345868 - DNA, 349 bp, Homo sapiens
ttcccacaaacccggaagcggatcgcgtggagtgaaggtcacgccgcggcgcgattgacttctaaagagtcatgctgtgatgaaaaagcccagaagagaaggaagaggaaagcaaaggagtcagggatggctcttcctcagggacacttaacattcagggacgtggccatagaattctctcaggcggagtggaaatgcctggaccggagcagctatgcattgggaagcaatgcagaagacaaaccaattaaaaaacaacttggagtatcctttcacttacatctgtctgaactggagctatttccagatgaaagggtaataaatggatgtaatcaagttgaaaacttta

SEQ ID NO: 345869 - DNA, 2456 bp, Homo sapiens
ttcccacaaacccggaagcggatcgcgtggagtgaaggtcacgccgcggcgcgattgacttctaaagagtcatgctgtgatgaaaaagcccagaagagaaggaagaggaaagcaaaggagtcagggatggctcttcctcagggacacttaacattcagggacgtggccatagaattctctcaggcggagtggaaatgcctggaccctgcacagagggctttatacaaggatgtgatgttggagaactacaggaacctggtctccctgggaatctctcttcctgacctgaatattaactccatgttggagcaaaggagggagccctggtctggtgagagtgaagtgaaaatagcaaaaaattcagatgggagggagtgcatcaaaggtgtgaacacagggagcagctatgcattgggaagcaatgcagaagacaaaccaattaaaaaacaacttggagtatcctttcacttacatctgtctgaactggagctatttccagatgaaagggtaataaatggatgtaatcaagttgaaaactttatcaaccacagttcctctgtttcctgtcttcaagaaatgtcttccagtgtcaaaacccccatttttaataggaatgattttgatgattcttcatttctcccacaagaacagaaagtacaccttagagaaaaaccttatgaatgtaatgagcatagcaaagtctttagagtatcttccagccttactaaacatcaagtaatccatactgtagagaaaccttacaaatgtaattcatgcggcaaggtctttagtcgcaattcgcaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttg

SEQ ID NO: 345870 - DNA, 1859 bp, Homo sapiens
ctcatgtaccgtacgcgatgttcgtgatcatgctccttgctgccacctgtgcggaatggacatccgaaagaaaaaccttatgaatgtaatgagcatagcaaagtctttagagtatcttccagccttactaaacatcaagtaatccatactgtagagaaaccttacaaatgtaattcatgcggcaaggtctttagtcgcaattcgcaccttgcagaacattgtagaattcatactggagagaaaccttacaaatgtaatgtctgtggcaaggtttttagttacaattcaaactttgcacgacatcaaagaattcataccagagagaagccgtatgaatgtaatgaatgtggtaaagtcttcagtaataattcttaccttgcacgacatcaaagaattcatgctgaagagaaaccttacaaatgtaatgaatgtggtaaaggcttcagtcataagtcatctctagcaaatcattggagaatttatactggagagaagccttacaaatgtgatgaatgtggcaaggccttctataggattgcgctccttgtacgacatcagaaaattcatactggagagaaaccttacaaatgtaatgaatgtggaaaggtctttattcaaaattcgcacctagcacaacattggagaattcatacaggagagaaaccttacaaatgtaatgaatgtggaaaagtatttaatcaactttcaaatcttgcacgacatcgaagaattcatactggagagaagccttacaaatgtaatgaatgtggtaaagcatttagtgagtattcaggcctttcagcccatcttgtaatccacactggagagaagccttacaaatgtagtgaatgtggcaaggcattcagacacaagttatcactaaccaatcatcagagaatccatactggagaaagaccttacaaatgtaatgaatgtggcaaggtcttcaatcgaattgcacaccttgcacgacatcggaaaattcatactggagagaaaccttacaaatgtaatgagtgtggcaaggcctttagtcgcatttcatacctagcacaacattggacaattcatatgggatagaaactacaaatgcaacaaatgcgtcaaagaatttagtgtgcactcaagccttactacccatcttttattccatactgcaaagaaattttgcaaatgtaaagaatatgacaaggtcttcaaacacaagtttttctaataactcattagagaatttatactggagagacttcacaattataataaatgtgtggaaaagtcttcaaaaaaatttcacaccttgcaaaaggagatctaaaaaacacaatcagaaatgacaaaggggacattaccaccaaccccacagaaatacgaaaaaccctcaaagattactataaacacctgtatgcacacaaactagaaaacctagaaaaaattaataaattccttgaaagatataaccccccaagattgaaccaagaagaaattgcatccctgaacagaccaataatgagttccaaaatttaatcactaattaaaaatctatcaaacaaaactctggaccagacagatttatagttgaagcctacgagatgtataaagaaaagctgttaccaatcttactgaaactgttcaaaaacatggatgcagagggactcctccctatctgattctatgaggccagcatcattctaataccaaaacctgacaggcacaatgaaaaaagaaaacttcaggctggtactcctgacgaatataggtgccaaaatcctcagcaaaatactagtaaaccaaatccatctgcacatcaaaaagctaatccaacattatcaagcaggctttagtgttgggctgcaaggttg

SEQ ID NO: 345871 - DNA, 515 bp, Homo sapiens
aaaacattactaattataaagggggaaagtgtaactttgctgtggagaaggctggtagacatcaccttactcagacggccaaagtggaaatctgctgtcatggaacaaactgaaattgaggtgggaagaatacaacattgtttctatctatgatcttcccgcctgagatgtaaaacctcaatctaatcacagagaaacatcaaaatccacactgagagaacttctacaaaataactggcctgtaattttcgaaattgtaaaggccatgaaagtcagggaatagttaagaaacggttccagattaaaggaagccgaagaggcatggcaactaaatgcaatgtatgattctgaactggatccttttgttataaaggacattattggaataattggtgaaacttgaattggatctgaaaattagatggtagtaatgtattcccgttagtgattttgatggttgtattgtggttattaggggaatgttcttttgtttgtttgtttgtttgtttgttttt

SEQ ID NO: 345872 - DNA, 332 bp, Homo sapiens
tttttttttctgatttaccagacaagaatatccaaacaccaaactgtgtaaatatttcaaaaccatacatacaaaagtattacctaatttgtagtgacttatcaaggcagggaagtaggaacttaatattcattaagtcatttgacattcttaacaatgtgcagaagatcatgctttgtgcagagttcaaaatagataacaaatgccttcttctgtgggaaaaacatgaacatcaatgtgtctaaagggctattcagtacatgttttgtatgcatcattatttgtatgctttataataatcgtcgagttaggcctattttatagatgagaag

SEQ ID NO: 345873 - DNA, 274 bp, Homo sapiens
tgtgtttgtctttctaatatggaaatgaaatcatcaattactaacttccagtatgtttcagttaagccttttagaggggcttcagccttttgaatgaaagcagtgaggttgagtgaaggtttgatactcacttccatgttctgtttgctgcatctgaaccactagcagactgacttgaggtttctctcacaaaagctgaagggattcacaggtgcttaggttaagtactggagagaccttcttgctgaggcctttaacaaaattgcaaaagaca

SEQ ID NO: 345874 - DNA, 397 bp, Homo sapiens
ggctgagtagttctattacatcttcaaaaaactgagctccagttcttgatggagacagaggaaggtcattgaggaggtggttcagctcaagagctaagtgaaaaatgtcttttgattcactcctgcttgtggatagaagtcatcttcgggatggaagagggagtgagatgacctagagtcttgaattggtggatctgcaggaacagaaactaaatacagtggagacctcttaactgagtaacaccacgagatggatttcctgacaaagtgccaatataggctaaatataaagattaaacatgtgcaataaaagtgatcatgcacttgtttttccagatatcaaatgcatttgtaccattttatgaatacatgttttcttaataactgattataaaac

SEQ ID NO: 345875 - DNA, 691 bp, Homo sapiens
tcctcaaacttattcgaccgtggaaatcttttgtcatgcttatttgttactgtctctcgctgtacttctgtggaatgtgcttttgagaaatactgacctagagaatagctatgtatgccagaggtaaagtttggcctgtggagcagactgtaaataacaagagaaagcgtcttgtctttattcctcttgctctgatcgtcagctccaactggtcacagacagaatggtattttgggaaactgaattcactctacgaggtgggcaccagtgaaccactaaagctgagtcaaagattagctgaattgaggatggacatgatgaagttaattccgtcaaccagcttcagaaatgggaaaaatggctttaacgtaaggtaaaatagaggtgctctaagtgagataaaatactcggtcctggctgggtgcggtggcttacacctgtagtcctagcactttgggaggccaaggtgggtggattgcttgagctcaggaattcaagaccagcctgggcaacgtgatgaaaccctgtctctacacacacaaaaaattagccaggcctggtggcacatgcctgtggtcccagctacttgcagggctgagatgggaggatcgcttgagcctaggaggtcaaggctgcagtgagctgagatcacaccactgcactcctgcctaggtgacaaagtgagactgtc

SEQ ID NO: 345876 - DNA, 715 bp, Homo sapiens
ctctgtggagctggtggtgctgcctggtggggctctctctgcccaggacgtggaacaactttcagccggaggactagaggaaatagttgtaggggaggaaaaattgtttccttctagccttttaggtcatttggctggtctacaaattaaattgatgtaagacagaggaacatgagaaaaacgatttgtcgaccgaaaggtgaaataacaggtactaaaacttaaagaaatcatggttagttttattactcggccaagtttgaggacttaagcctgggaacacagactcagtatagaccgagaacgtgtcccaaagtaagttagctgggagtataacctgaagaagactgagttttaatacccagaatatttgagtatcaatatctagactactgtgtcattttgtcgccaaagtaattttttatgaatccagttttgcaccaaataccaatatgacttaaatgttgtctgattgtgaggcctaagatggtcacagtctcatttatctttcttcctcaacaaaaacattttccatatattacatattattttgaatgggtagagactaaagccacgtttctataatttcaggattttaaacattttgtagacgataacattcgtcttgaagctgtggacaatctaaaacagaaatggagttccaaattttgtttttgtaatatggcccgtcaactgcacatgggaagaatgtggg

SEQ ID NO: 345877 - DNA, 1392 bp, Homo sapiens
gcagcgttagattctcatagcagcgggaaccctgttatgaaccgcatatgcaaggggtttgggttgtacactccttttgagaatctaatgcctgatgatctgaagtggaacagtttcatagttttatcctgaaaccatcccctgtcccagtccatggaaaaattgtcttccacgaaactagtccctactgccaaaagggttggggaccactgatttagagaagacatgctttaagttttatgtagaatataggcaaggtagtaaaaacagacatcattctgcatcatgtaagtatgtgtagtaagaaaaatttgctacagtttgcccaagtaatcccaaaggaatcatgattggattttttttaattgaagaaaaagtaattgatgtctcaaaattataataaaataattataaaattatcctagttttttccataaaagtaagatttaatttggaagtttgaggacaaaataggataaatttaagaaacacaagtagagttagcaaatttggacaatattttccgccttagcacattcaggctgctatataaaataccataagtgggtagctcataaacaatggaaatttatttcccacagttctgatgtctggaagtccaagatggaggtgctggcagatttggtgagagcctgctttctggttcacagaaggagccttctcattatgtccttatatgatgaagggccaaacaagctcccttgggtgctaatcccattttcaaggactctgccctcatgaccttatcacctcccaaaaggccccaccacttaatacaatcactttgggagttaggatttcaacaaatgaatctcagggggacacaaacattcagaccataggaatgttgcatgcatagttttgagtctaaattcaaagatttgggcacttatttttagcagtgatttttagaattgcttctattgtattttttaaaaatactgttattcttcgttttcaatataaataatactggtttaaaaagcttagtgctcttggggacactgtttatattttgtgagtataatatacttggaatagttaatctcattcttaaaattccattgtattctgatggctatttaatctgttatgtgcatatgcaggtacaacagagcctgtatcatggaggggtccagcatgaggaattcggactggttttcatttgcccatttgctgaaatacagccattgttttttcccaagtggtaatcatttaaaatttttcctggcttaagatagacgggatcttaatgcatacttcattatgctgccttaaacttttaagaagaaaaggatttgtacttgaaagaaaaacttgtcaactttctcaaatctttgataaaatataaatttgacttatcaaagcctt

SEQ ID NO: 345878 - DNA, 1223 bp, Homo sapiens
ctcagtttattagtatatcttttcaatatcatcacatatgtacttgttaccaaccgattgtgaataagaatattctggattaccgaacaaatgtagttgaagatctgctttgttttttagaccaatgaaatttctgataaagcttgattatagttcatatgtttaaataaggagggtttttttgtttgtttttttaataccttcttgaaggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345879 - DNA, 409 bp, Homo sapiens
ctcagtttattagtatatcttttcaatatcatcacatatgtacttgttaccaaccgattgtgaataagaatattctggattaccgaacaaatgtagttgaagatctgctttgttttttagaccaatgaaatttctgataaagcttgattatagttcatatgtttaaataaggagggtttttttgtttgtttttttaataccttcttgaaggtgtggtgcttatttccctggcactatgtgcagatgccgtcattggaaatgttcaagagaaagctatgaaacttcataatgcttctaattctgaaatggtaaatactctagtgttttttcttcaaattagacagatttaaaaaatggtgatacacgtaatttgatgaaataattattataactagcattgcatttttaa

SEQ ID NO: 345880 - DNA, 300 bp, Homo sapiens
agtctccctcattgggagtgaccctgaaggtgtggcttccctcccactttttcctcagtattactttgccttagttttcccccaatggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345881 - DNA, 2215 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345882 - DNA, 1949 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345883 - DNA, 2018 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345884 - DNA, 1921 bp, Homo sapiens
gcagggacacataggcggaagtggcctgcgggcgccggagttgagagtgctttccggggaggcgaccgccgcggtggaaagtgcaggagtgggcgaggaggaggaggaagaggaggccatgattgattccggagcgcagttaatcaaggcataatggcatgattttcagttttgctcataaagtttgccagtaccaccatccatttcaaaaatcgtatccaagcagaaggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345885 - DNA, 1550 bp, Homo sapiens
gtttcttcatctggaaattggattatgataactaagaatacccatatctagggtggttgtgagaagtaaatggaataatccgtaccgagcttcaacacagtacctgacacacagcagatatttaggtttgctgctgctgctgctgctgctgattctgtttatgaaaagcatagtaaattgggattaaaaggttggttggaaaatagagaagttaagcagtagatatgccatatgctgcttattttcattatattttaatgtattttagaaacttaatttttttatgttttataagtatctttaaagctttttgttttgtttcatttaagtattttttttagaactctaatatgaaaatctggttgatttcaataattaagcctagaaagaaatgaatatgtaagcatatatgaaaggattaatattactaggtgttattttgtacataaaatgaggcatagacttataaaacattagaatcaaataacatttctggaaatttaggccatattgaaattataatgtttcttttaaaatgtttgttctgcaaacctaattgagccatagagttaaaacccttaatcttccattttcagtttcatagtacttttttctgctttatttttatctgctctgtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345886 - DNA, 2149 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgagatgtatcttgcagttatgaaattcctggaatggccggttggagatatggttatattctattaaatgagtttggagtgtttcatctggggtttaggttcgtaaaaggatgggggaaatttaatttggtttgaaaaaggggtatggggaactaacagtaaggatgagttgttttattgtttttttcg

SEQ ID NO: 345887 - DNA, 1840 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtacaacagagcctgtatcatggaggggtccagcatgaggaattcggactggttttcatttgcccatttgctgaaatacagccattgttttttcccaagtggtaatcatttaaaatttttcctggcttaagatagacgggatcttaatgcatacttcattatgctgccttaaacttttaagaagaaaaggatttgtacttgaaagaaaaacttgtcaactttctcaaatctttgataaaatataaatttgacttatcaaagcctt

SEQ ID NO: 345888 - DNA, 615 bp, Homo sapiens
ctgcattttttctacattaggatatcagaagcctagaattgttttttgattaaacgtttttctaagtgaattgagatagtttggaacttggaagagaggcagcatttcaaaataatttagacagcgttatttttacttaattacttaatatataaagtcctagtgttaactttttctcttgaaaaaaaaagaatagtcttcaaacattagcacagggtttctccaccttggtgtaatgatgtgtgtacaaagaaatgagatggaactttgttttttctgttttataatcgtacaccataggccatgattgattccggagcgcagttaatcaaggcataatggcatggtaagattcttttatttgtaacgttgagtgtggcaaagtatagttaaaatcacgttttttcaggttaatgacaccgtaatgacttttttttcatattctacctttttttggtgtgggacttttgtccttcaggtcggaaaactcaaaaataaactgaaataattgtgacttcaataggtcattgtaactcaacattatcactaattttaatttttaaatatacattgtatgccggaaatgctacctttttattccattttagcagttga

SEQ ID NO: 345889 - DNA, 1056 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggtgaggtgacctcaaggggtcttttacgctgttctcggggtctctggagaactgtcagtcacctggatacctctagactgtatttacagttaactgtttcctcgttccgtgtttattaaataggggcactccaaggtactcttttctccatttggcttgcagtagaatgtgattgttctggctgggctattaagtttatggcataaacttccactagaagttctgcaagtttcctccagtctttgcaactgaattatctctcccgtctttttattatttaaggaatattgaaagtaaaagatggaatgatttggtgcgctaacaaaatcttaagtgttgagtatctgcattttttctacattaggatatcagaagcctagaattgttttttgattaaacgtttttctaagtgaattgagatagtttggaacttggaagagaggcagcatttcaaaataatttagacagcgttatttttacttaattacttaatatataaagtcctagtgttaactttttctcttgaaaaaaaaagaatagtcttcaaacattagcacagggtttctccaccttggtgta

SEQ ID NO: 345890 - DNA, 1903 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345891 - DNA, 2154 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggccatgattgattccggagcgcagttaatcaaggcataatggcatggtttgaccaaatatttaggagagataatttaaagcatggttttaaaagaaagtcacatctcaaagataccctgcaagattacataaaaagtcttacaaatgacagtgattgaaacataatgtgggaagcaagaacaaaggaaagcgaagaataaacaagaggaatacagtaaacttcatgaaacaacttttctattagatataaggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345892 - DNA, 2117 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaaaaaaaaaa

SEQ ID NO: 345893 - DNA, 1197 bp, Homo sapiens
gcagggacacataggcggaagtggcctgcgggcgccggagttgagagtgctttccggggaggcgaccgccgcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggtaaaaaagttatatgtttgtaatatgttaattatttataataattgcggtcagtatgggcatttactagttttgcccaagatagtcacttaggggatactggctgattcataaatttgaattttttagtatagagtagaaaagagcttcttaacagatcaaaattcaagagttaaataatttaagtggggaggaggcatatgtagagactatcttgaaaaattttcattatgaaaattaagttttaaatatttaacaaaatgtgtgcttccaagagaaagcaatgattcacgtattgattggtatcttggaatattattgaatgatagtgcagtttacttgattcttggagctcaataataaaagatcatttttgcaaa

SEQ ID NO: 345894 - DNA, 537 bp, Homo sapiens
gccgcatctggtcacctttctggtgcacctctttggacagcagccatctggctgttcccagcctgctcccaccctgtgttttagttcgctatgcacttttaaatgtcagcgtgatcgtactcccggtgcacttttgtcagctcaggaagcaggccctctctgtaagccttgcagctggtgctgggcgctgaggagctctccaagctcccgggcactggggaattcagcccagggagttctcaaggttggagccctggaagccaggatgagtaataacccttcagtggccaggatcggacttcatcagcaccatagtaactgtctttatcttctccatcccccactccctccatccgctagaggtggaattctcaggcttggatgtgggggaggggaaaatgatggatttcagaaaggcctgggctagaagtggaaagccagccaaggaaacccagcgccccccaggagtggtggtggggacagagtcccccgggaacgtgcctgcggggtgaagatgctagacttggggaggaccca

SEQ ID NO: 345895 - DNA, 602 bp, Homo sapiens
agggccacaggggaagcaccggtgtcggtcgggggcagaagcaggagcaagaagaaagcataggctttgactgaggtttctgcagggaggcaaggcagagcaaggccaacagtttccaattggcaagtctgaataattccagcaggctctgggctggaggggcggtctccatttgcttggtacctagcccctggggtgagttagggcaatttctatattggcttggtgtgtgaaagttagataaaggggaaggttgcggctatgttcttgacaatagttagatatgctcagggctcagtcctttgctgtctccaagaattagctagtcctgggagtctcttccctgccagcaaaatttataagataccagaacatcataagatacagaaaaaaaaccgtgatgaatgcaacttcacaatattgcctcctttttccttgcactgcctttccctgatccctctaccactttggttattgtgacagcaacaagattcatctttcaaccatctacaccaggggtcagcaaactatgggctgatggccagatctagccagctgcttgttttgtatggcccacaaggtaacaatgctagaaaaaaaaa

SEQ ID NO: 345896 - DNA, 438 bp, Homo sapiens
tatacacagcggtgtacaagtatttatgtgagtctttgttttcatttgggtatgtatctagtggaattgctgagaaatataattttgtttagtattttaaggaaccaccaagctgttttgcacagtatttgtaccattcttaatggcaatacacaagggttcaaatttctccacggccttcatcctggtgattgtgaagtgatatttcattattgtttgatttagagtacccttaaactaatggttttgagcatcctttcatgtgcttattggccacatgtatagcttcttggagaaatgtctattcaaatcctttgcccttttttgaattggttgtgaggggtttggttgtcaaattgtaggagttctaaatatattctgaatattaatcccattgccaaatacatgatttgcatatattttgtcccactttgctgt

SEQ ID NO: 345897 - DNA, 254 bp, Homo sapiens
tggtcctcttgtaggctgtttgactgtgggctctagtgctggaccatgtaagccattcttagcaaaggtttcaagacaaacatacattgggatgggagagagctatggggctggaagctgtttctctggagggcagaaagttttccccgcttcattcgtggcataagctcttgtgattttatttgtaagcctttattattattatttgagccggagtcttgctctgtcacccagactagagtgcagtggcgaga

SEQ ID NO: 345898 - DNA, 807 bp, Homo sapiens
ctcatcctcatggatgcagaggcaggacaatgccagtggactccccaagtttctcctgccttggattagctggtgttgggtcaagatgcagcccttatcagaggctttcctgggcttggagcctctcactgctgtggctgtgtgtcaggtggaggctggcttccttgtgaagtccctgtgcatagatggcaccctggtcctagaggaggctggctggaagtgagccactcttactccaggtgccagtgaggctgaatttgcacttggaaatgcgggtgcctgggcagcatgaagtcttggcccagcttctgctacacctgggacttgtggctcatgataagagtgcaggcagtgtacggtgtcagagctgtggctggaggtctcgccacccatttttagggtgtggctgctctcctgtgtgaattttggtggatcagcaagttggatgtcagagaaaagtgtcttgtgaaggagacttgtttcctacctgtgtgagtgctttggggatgaccagagggtaccccatgtccagctcttcccaaaactggtcctcttgtaggctgtttgactgtgggctctagtgctggaccatgtaagccattcttagcaaaggtttcaagacaaacatacattgggatgggagagagctatggggctggaagctgtttctctggagggcagaaagttttccccgcttcattcgtggcataagctcttgtgattttatttgtaagcctttattattattatttgagccgggagatcatgccactgacagagtaagtgagaagctgtctcagaaaaaaa

SEQ ID NO: 345899 - DNA, 503 bp, Homo sapiens
ctgtggtgttggtttccaggccccaccaatctgtgtcagttcccctggagccgacagaaaaaaaaccctcagcctgagtccagagaggtaaagtgactcccccaaggtcccacaggtagtaagggtagagcagccctcagactcagaccatttcacttctgaattctgggggctggaaaaaaatccttctcaaaaccagaaggtgcgctgcattgggtctgagagtgttggggccacttgtgagatcagggacttgcaaacaagtgcctatgagggccagacaggggaaaatgctacttaatattactgagcacttaactttgcaccagactgtgcagagagctctggcatgggtcctgtcaagcagtccctgcagctctgagaagtgagtactctttgcaccatttgcagatggggaaactgaggcacagaggtcatgtgatatgcccaaggtcacacagctggtaggtggcagaatcaggatttgagccagcgtctgtacc

SEQ ID NO: 345900 - DNA, 2357 bp, Homo sapiens
  misc_feature (1526)..(1526): n is a, c, g, or t
tacttctgcccccggctgagacgccggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccaggtttgccagtttagatcatcaacattttctgatgtagaagctcattttagagcagcccatgaaaacactaagaacttgctatgtccattttgcctcaangttagtaaaatggcaaccccctacatgaatcattacatgaagcatcagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatggtacgtatatataattg

SEQ ID NO: 345901 - DNA, 1744 bp, Homo sapiens
  misc_feature (913)..(913): n is a, c, g, or t
agtaagccagtataatagataaaacaaaaggttcttgtaattatagtcattaaaattgctattgcatgcatttagaaaccaagacacaaataaaaatataccagcagtttgtcttttgagcagctgaaaccttcagagctttcaaagatttgtctcttcactgtagctgcttttggtggtagagtttccatcctttcagtattttattttaaaatgtaaatagtatttcatgtatggaaaagaagcctgctatttttctttgctaaaaaaaattttaaatctaaaataatgatatagtgttacagcaaattagtgatgtttcatactactacattaatggattattttagaaacaaagataaaaaaaccttactgagccacttaatgaaagtaaattatttaaagtacacactttatagagtgctttcaggccttggagatgttattttgagtcatagaattacattttaaaaatttattttcagagacttatttgtgaggtttttctttggttataagtctgaatttttgctcttactggcaaattgtttgtaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccaggtttgccagtttagatcatcaacattttctgatgtagaagctcattttagagcagcccatgaaaacactaagaacttgctatgtccattttgcctcaangttagtaaaatggcaaccccctacatgaatcattacatgaagcatcagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatggtacgtatatataattg

SEQ ID NO: 345902 - DNA, 2166 bp, Homo sapiens
  misc_feature (1335)..(1335): n is a, c, g, or t
ctcttctcttgaaaattagacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccaggtttgccagtttagatcatcaacattttctgatgtagaagctcattttagagcagcccatgaaaacactaagaacttgctatgtccattttgcctcaangttagtaaaatggcaaccccctacatgaatcattacatgaagcatcagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatggtacgtatatataattg

SEQ ID NO: 345903 - DNA, 494 bp, Homo sapiens
tttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctagtaagtgaaagtttctttggaatcctgaatattgttgactttgatcatccgaactgtgaggaaaccttaaaaattctggcagaaaaaaataagaagtagactttgtaatatgagggcaaaattgaaaaaaaaaatcataacttttataaacctagatgaaatgtgttctaaagccaggtgtgatggtgcatgcctatacacccagctactgaggaggctgaggcaggaggatcacttgagcccatgagttcagtactatagaatgctatgatcaattgcacctgtgaatagccactgcactccagcctgggcaacatagtaagaccctgcctctaca

SEQ ID NO: 345904 - DNA, 2210 bp, Homo sapiens
tacttctgcccccggctgagacgccggttccgcgctggaagtctccgggggagtcgctgttgctgaggctgtcgcctgaggtttttcgcgctcctccctttcctcctcctctttctcctcctccttatccgaaccccagtcagaccgatctgctctgctctcggtgaccttgcaacttcatggatgacgacaaaccttttcaaccaaaaaacatttcaaaaatggcagaactctttatggaatgtgaagaagaagagctagagccatggcagaagaaagtagaagaaactcaggatgaggatgacgatgaactgatctttgttggagagatatcaagttcaaaaccagccatttcaaatattttgaacagaggccactccagctcatcttcaaaaggaataaagagtgagccacacagtccaggtattcctgaaatattcaggactgcaagtcaacgctgcagagacccaccatcaaatccagtggctgcctcgcctagatttcatcttgtatctaaatcttcacaaagctctgttactgttgagaatgcgtctaaacctgattttacaaagaattcacaagttggatcggataattcttcaattttactgtttgactcgacccaggaatcactaccaccatcccaagacataccagcaatttttagagaaggtatgaaaaatacttcatatgtgttgaaacatccttctacttctaaagtaaacagtgttactccaaaaaaaccaaagaccagtgaagatgttcctcagataaatccctccacttcattgcctttaattggctctcctccagtgacatcctcccaagttatgctgtcaaaaggtacaaatacctcatctccatatgatgctggagcagattacctaagagcttgtccaaagtgcaatgttcagttcaatcttttggatcctttgaaataccacatgaagcattgttgtccagacatgataactaaatttttgggagtaattgttaaatcagaacgtccatgtgatgaagacaagactgattcagagacaggaaagttgatcatgttagtcaatgagttttattatggaaggcatgaaggagtcactgagaaagagccaaagacttacacaacctttaaatgcttcagttgctcgaaagttcttaaaaataatattaggtttatgaaccacatgaaacatcacttggaacttgagaagcagaacaatgaaagctgggaaaaccacaccacctgccagcactgttaccggcaatatcccacacccttccaactgcagtgccacattgagagtacacacactccccatgagttttctactatttgcaaaatctgtgaattatcatttgaaacagagcatattcttttacaacatatgaaggacacccataaacctggtgaaatgccatatgtttgccagaaaaaaggagttcatcgttgcccaaaatgcagactacaatttttgaccagcaaggagaaagctgaacataaggcgcagcatcgtacatttataaagcctaaagaactagaaggattgcctcctggagcaaaagttactattcgagcttcacttggacctctccagtcaaaattaccaactgcacctttcggttgcgctccaggcacttcttttcttcaggtcacacctccgacatctcaaaatacaactgctagaaatcctagaaaatctaatgccagtagatctaagacaagtaagcttcatgcaactacatccactgcaagtaaagttaatacaagtaagccaaggggacgtatagctaagtccaaagcaaaaccctcttacaagcaaaagcgacagcgcaacagaaaaaataaaatgagccttgctttgaagaacataaggtgtcgtcggggaattcacaagtgcattgaatgtcattccaaaataaaagattttgcaagccacttttctatatacatccactgcagtttttgcaagtacaatactaactgtaacaaagcctttgtaaatcatatgatgagctctcatagcaaccatccaggtaaacggttttgtattttcaagaagcattcaggaactctcaggggcattactctagtgtgccttaaatgtgatttcctagctgattcttccggcttagatcgtatggctaaacacttaagtcaacgtaaaactcatacttgccaagttataatagagaatggtacgtatatataattg

SEQ ID NO: 345905 - DNA, 245 bp, Homo sapiens
ggacaaccttcttctctttccattgcaaatcttagaactccaggtcctctgacttttagactctgggacttgaaccagcagcccccaggtctcaggcccttggccttggactgagagttataccatcagcttctgtggttctgaggccttcagacttggactgagccaagctacctggacctccagcttgcacatagcctataatgaaacttcttagcctccatgatcacatgacccaattcccc

SEQ ID NO: 345906 - DNA, 386 bp, Homo sapiens
aaatagataaaactgtcaaaagtatgttgtcaaacacgtcagagttctgtttttatgccataatgtaacaattgaaaatttttcatcaaaataaaaaataaatagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggaccccaattccccttatagggagccgttttacaattaattggccgtcttttaaaaacgtcggaattggaaaaaccttggctttcccaaacttaatccctttgaaaaaaatccccttttcgccagttggcgtaataccaaaaaggcccgaaccaatggcctttcca

SEQ ID NO: 345907 - DNA, 543 bp, Homo sapiens
ttactcacttcccaccctgtgccttgtaaggtcctcacccgcgaggtgcattcaccctttgggtcccctaagcctcgcccttcattgcgtctgcacagcagcaccgcagctccggtgcaagagagtcctcgccctggtcctgggattccacagatcccacccctcccctgagacaccctcccatcttgctctcattgagccttgccctctatcctgcaggcctccccctcataagcatggcttcctctgacccagcgttgaaggaggtgacttgggcctgtctgttcacctccaatgttcttttgtcccagattccactccactaggaaaagtgctttcagtaggtgggcatcttattccatccccttccctgtaaatatgtggccacaggggatcaggagaaagagagacaggagaaagaggaaatagaaaaactgagaaggagtgagaaggacgggtgagaaccatgaacagatggcaacgcagaggatgggtggggaatttgcagacagacactgagagtgaaagacaaagctgagaaag

SEQ ID NO: 345908 - DNA, 923 bp, Homo sapiens
cctggtgacagtgtaagactctcttaaaaaataaaataaaataaaataaaataaaaaatcaaccatagttccacaactaagagacaattacagttcacattttatttccctggtattttccctctgcatatgtgtgtttatatctgtacttttaagggaaaattgatatcacactatacattcaccatgtacagatctgctgtaagggctggaaacttggcattttcatacagagccaaaatttgatgtgctcaaagaaaactttaagttagaaatgttactctggtttttatgaattttctagcagttgagggaatgggttcttgtaaatacagttactcctagttttcttcctgaaaaccatatgtaaaatatatatatggtcttcaaatggaaggtttttttgtttttttttagctgtgcctctgtgggctgagtgaccgtgaccgcaaggtggctcatggagaactggtgggtgtgcaactgctactggaagatgttctgagtagctatcatgtgaccatggaggccccccaaagacagcaagccacactgggcaaaaatacacagccagattggtccaaagtgccaggattcagaagtcagttccgaagcagcccaaagacctctgagctgctggagggcctgtgcgatgcggtgatgtcctttgctttgctgagatcatttctgatactgtggaagcagctggaagtgctaaaggagcactggggccgactcaagctgcaaggccaggatatcaactctgtctctctccacaaacggttttcagagctctatgaaactgacgttctctaccccagcatgaaagctatagccaggcagatggggaaagaagatgaatttgaaggatttatagtaaataatcagtctgttcttccccccagtggagcctcagaagttga

SEQ ID NO: 345909 - DNA, 563 bp, Homo sapiens
ttcccaatagcaaaaggcagtgtaaaggtagttcactccaaaagttttgcttagggttccagagctcatagtaatttcactcgtcctaagacatcacaaggctattttagagaacagtatgtttttccttactcttggttcaagcaagaacatccaaaagtaacctgatgtaccaatgtgactccttatcccaagctaaagaatatcctttcaaggcaaattcatccaaatcagcttgacatctgatgggagggggttggataaacaaggttgtagagaaatcaagtctgaagagtaaccttgcacagcttgatctgtttactttttaaatgcaggtttgttcagtgggtatcgcactctacttttgaaacataggactaaattttcacaaaaatgtgaagatcctgcccgtgtactctggaaaattgcttgtctaattgggtgcacagctgcacctgtaccctcttgaatgactcagtcatggtgtgctcaagggccaagtaacttgttatggtgctaagtgaagaacaaaaatatataaaattcagttactttggcaatga

SEQ ID NO: 345910 - DNA, 655 bp, Homo sapiens
tggctcacgcgtgcgccctttaaatagtgacccccggctccagaattcgatggcactttcgatctatcccatcgacgcaaatcactggagctttagtagaaaatcaactggatcttcaagaaactaagtttccaagatctgactgctctgtcccttacgaattacgtgttccttagcaacttaacttctctagggctgaagtttctttaccgacataataagagagatgggtatgggcatcacatgctcaaaggcctgaggggcagctcggatgactttaaatcagtatggaatatcttgagatatcccaattctagagatgtttagaagcagaggatgaaaagtgtgcaataatgtctttgcacgctcttatttatcatctctcccacagattactgcaatgacctgttaaccctgccttgactcgttttccctgtcccctccaaacttgtggtgacattacactcagagtgaactttttaaaaatacaaatcttattccatcactcctgtggaaaactgcgaaaacaaggaactgcaaaaacaaagagctacaaattgctctcattcctgtacacacacattttcacaatatgactttgctgccaattccatcaaaaggttcaatctgtttctccatgtccctagatcaaagc

SEQ ID NO: 345911 - DNA, 208 bp, Homo sapiens
ctgtgatatgagttcagttaatgaaaactcaaagaatcagaagtaattgttttcttttttggtgggtccagaatttaggcgtgtaaaaaataaaataaaattttaggaccttccagatttattatgtcaaggggtaatagttaagccctggaaactgaatcaacctttctttcttttcttgtattcattcattcattctttctttctt

SEQ ID NO: 345912 - DNA, 446 bp, Homo sapiens
catttactgcaagccagttttttccagaggaacaataactaaactaaatcacttactatattctgcacgtatttgttgcgttcccacagagtgccaaaaattttgaaatagtaagtaaattttgaaatgcaggattaaaagtagaattggaggccaggtatggtggctcaacgcctgtaatcccagcactttgggaggtcgaggtgggtggatcactagagcccaggagtttgagatcagcctgggcaacactttttttctctacaaaatatatatacgcaaaaattagctgggccagtggagcttgtctgtggtcccagctacctgggaggctaaggcaggaggatcacttgagcccagaaggttgaggctgcagtgagccatgatcgtgccactattctccagcctgggtgacagagtaagaccctgtctctaaaaaaaaaaaa

SEQ ID NO: 345913 - DNA, 832 bp, Homo sapiens
aaatatccaagaactgtgaaacaattacaaaaggtataagtgtactagaacaccagaaggagaagagaaagctaaagaaatctttgaaacaatcactgagaatttatcctaaattaagtcagacaacttgctttatcttcttgctactgcatgcactctccctcttctctgtgtatatgtgtacacacatgggaaaacacacaatttgaacttttttttttaacttttaacttcaggggtacatgtacaggatgtgtaagtttgttacttaggtaaacgcgtgtcatggagatttgctatacagattctttcatcacccaagtattaagcctagtatcttagttgtttttcctgatcctcaaacaacattttaatgaaaactttttaaaatacaaaactagaaataggcattaatagcgttagagcagccagattgtttcatttttaaatttgcaagcatttttacatgggtcttgtctacccacttttacttccttacttgctcctgctgttacgttctctgtcaattgttaaatgtgaaaaccaggccaggcacagtggctcacgcctgtaaccagcactttgggaggccaaggtgggcagatcgcttgagtataggagtttgagaacagcctgggcaacaaacatggcaagaccgtgtgtgtgcaaaaagttatctgggcatggtgattcatgcctgtaggctcagctactcaggaggctgaggtgggaggatggcatgagcccaggaggtcgaggctacagtgaggtgtgatcatgccacctcattccagcctgggcgacagagcgagaccctgtctcaaaaaaaaaa

SEQ ID NO: 345914 - DNA, 688 bp, Homo sapiens
tatcttgaggatccctgctgctgactatttgttgtatcgtatataatattgtatgatatgaatatgccacagttcatgtatccagtctactgttagtggacattgggtacattctgaattctaggcttttacaatgaaagcttcttttctccttctgctgtgcatgtattcacacttctgttgagtacagatccagaagtaggaacgctgggtcagcggcccctgagagtctgcgcttgtggatgagtctgtctcttagttctgtaactttttggttcacatactttgatattatatgaagtggattgctctcttattgataattgttttatctacctgttgaattggcctttgggtggttatgaaatgcctctcttcctctaacatcgctcaccacctgcagtacgcagtgtctgatattagttaaactgtggaagcttttcttcagttagtgatggcatgggggtacttttggtatcgttttaccttcacctttctttgctccatttcagtttaatttctgctacttgctactgttgttgttatctgagatttctgaatcctatgtgatcatctttgcttcttatttggagtatgtagttaattttcatttagtgcattagattgaaccatgtggaactgcaatattagataacaaccacaaatagtcagcgggacctgtgtcccc

SEQ ID NO: 345915 - DNA, 1804 bp, Homo sapiens
caatggcgggctcccctcccccagcctcgctgctgccttgcagtttgatctcagactgctgtgctagcaatcagcgagactccgtgggcgtaggaccctccgagccaggtgtgggatatagtctcgtggtgcgccgttttttaagcccgtcggaaaagcgcagtattcgggtgggagtgacccgattttccaggtgcgtccgtcacccctttctttgactcggaaagggaactccctgaccccttgcgcttcccaagtgaggcaatgcctcgccctgcttcggctcgcgcacggtgcgcgcacccactgacctgcgcccactgtctggcactccctagagagatgaacccggtacctcagatggaaatgcagaaatcaccgtcttctgcgtcgctcacgctgggagctgtagaccagagctgttcctattcggccatcttggctccttattctcattaccttcttgagttgtggctcagacactacaacagagctccgtcacctctttctaaaagctgggaaatggttattgtcaacgccagccccattttggaggcacctggttgcaggggaccacagctagctgggtgcggtggctcaggactgtaattccagctacatgagaggattgcctgaggccaggagtttgagaccagcctgaacaacataatagactgggagctccatgaggtccgagacaacctgaagacgcccagctcagcagagactggctacggcaatcactcagtaactatttgttgaattggacataatagaagagctgaagaattttaaacaagtcaccatcagtgcagtggattcctcaaagcaaacctggaaatctcggcatgagttggatttaaggcagtacattttcagctcctgaaaatttgaacagtttctcaagagaacaacttgaaacagaaaggcaaggatgtagatgtggttgtagaagatgatgtctgcggccaccaaactgtccactgtgaagacaaaccatgcatgtttagtaggcagtggctcctcttccctgtggggagtcccactgcttccctggcctgggtgttctctgccggtagatgttattgacaaaataagcaaagtcctctgattctgagaattagagttaatgatagctctagattgcctctgccatgctatttaaagtcctgctttattgtctgacatgagttcggcatctatgaggacttgtccagtgcaaagtacaatctccactgaaagatatcaccagcacatcttgtcactgtgctgtagcaagctgggcagtacaatgatgttggcaggatcctgtttaggtggaggatggccacctgggcatcaagaatcttctaccctgattccacattgactccccaaagtgggcttcagacagctctttacttacgtcttctgattaaagcagcagacagggtcccagctagagaaaagttctgggagcaggagaggtgttggtggctttaaaaccaggggtgaagattgaattaggaggttaggcaggagtaggatcaaagacttagaaaatgcttgtttcctcctattattcttatgagagctgatacggggctttcagttttgggggagagccttggaagagaatgagggaatttaatcaactagcgggacctttccaacttacatttcccagtgtttgttggatgatacgtttgcctaataagttaaagcttccaaaaatagaaagtaaagcttggtgacactaagctctggcatgctgtcatcttctggctaggggtcttgtgcttctgtttttctatttctgaccaaa

SEQ ID NO: 345916 - DNA, 735 bp, Homo sapiens
caatggcgggctcccctcccccagcctcgctgctgccttgcagtttgatctcagactgctgtgctagcaatcagcgagactccgtgggcgtaggaccctccgagccaggtgtgggatatagtctcgtggtgcgccgttttttaagcccgtcggaaaagcgcagtattcgggtgggagtgacccgattttccaggtgcgtccgtcacccctttctttgactcggaaagggaactccctgaccccttgcgcttcccaagtgaggcaatgcctcgccctgcttcggctcgcgcacggtgcgcgcacccactgacctgcgcccactgtctggcactccctagagagatgaacccggtacctcagatggaaatgcagaaatcaccgtcttctgcgtcgctcacgctgggagctgtagaccagagctgttcctattcggccatcttggctccttattctcattaccttcttgagttgtggctcagacactacaacagagctccgtcacctctttctaaaagctgggaaatggttattgtcaacgccagccccattttggaggcacctggttgcaggggaccacagctagacccgagtcatccctggagtctcacacttgatcttagccaaaaggccgagaagcgatcatccctggagtctctctgaatctgccgtgatcctgggggctgcccgattcgtgcattgttcattgctcaattaaactcctttaaatttaatttg

SEQ ID NO: 345917 - DNA, 1482 bp, Homo sapiens
taacaaaaattagctgggcattttggtgcatgcctgtagtcccagctatttgggaggctaaggcaggagaactgctcgaacccaggaggtggaggttgcagtgagccaagatcatgccattgcactccagcctgggcaacagagcgagactccatgtcaaaaaaatagaaaaaaaaaaaaaaaaaagaaattgttggggttttttttcaggtgtgatactggtattgtggttatgtttttaaaaagtctttatgtttttagctgggtgcggtggctcaggactgtaattccagctacatgagaggattgcctgaggccaggagtttgagaccagcctgaacaacataatagactgggagctccatgaggtccgagacaacctgaagacgcccagctcagcagagactggctacggcaatcactcagtaactatttgttgaattggacataatagaagagctgaagaattttaaacaagtcaccatcagtgcagtggattcctcaaagcaaacctggaaatctcggcatgagttggatttaaggcagtacattttcagctcctgaaaatttgaacagtttctcaagagaacaacttgaaacagaaaggcaaggatgtagatgtggttgtagaagatgatgtctgcggccaccaaactgtccactgtgaagacaaaccatgcatgtttagtaggcagtggctcctcttccctgtggggagtcccactgcttccctggcctgggtgttctctgccggtagatgttattgacaaaataagcaaagtcctctgattctgagaattagagttaatgatagctctagattgcctctgccatgctatttaaagtcctgctttattgtctgacatgagttcggcatctatgaggacttgtccagtgcaaagtacaatctccactgaaagatatcaccagcacatcttgtcactgtgctgtagcaagctgggcagtacaatgatgttggcaggatcctgtttaggtggaggatggccacctgggcatcaagaatcttctaccctgattccacattgactccccaaagtgggcttcagacagctctttacttacgtcttctgattaaagcagcagacagggtcccagctagagaaaagttctgggagcaggagaggtgttggtggctttaaaaccaggggtgaagattgaattaggaggttaggcaggagtaggatcaaagacttagaaaatgcttgtttcctcctattattcttatgagagctgatacggggctttcagttttgggggagagccttggaagagaatgagggaatttaatcaactagcgggacctttccaacttacatttcccagtgtttgttggatgatacgtttgcctaataagttaaagcttccaaaaatagaaagtaaagcttggtgacactaagctctggcatgctgtcatcttctggctaggggtcttgtgcttctgtttttctatttctgaccaaa

SEQ ID NO: 345918 - DNA, 245 bp, Homo sapiens
ctttcagttttgggggagagccttggaagagaatgagggaatttaatcaactagcgggacctttccaacttacatttcccagtgtttgttggatgatacgtttgcctaataagttaaagcttccaaaaatagaaagtaaagcttggtgacactaagctctggcatgctgtcatcttctggctaggggtcttgtgcttctgtttttctatttctgaccaaagacataaaatgtgttgtgacctctc

SEQ ID NO: 345919 - DNA, 692 bp, Homo sapiens
caatggcgggctcccctcccccagcctcgctgctgccttgcagtttgatctcagactgctgtgctagcaatcagcgagactccgtgggcgtaggaccctccgagccaggtgtgggatatagtctcgtggtgcgccgttttttaagcccgtcggaaaagcgcagtattcgggtgggagtgacccgattttccaggtgcgtccgtcacccctttctttgactcggaaagggaactccctgaccccttgcgcttcccaagtgaggcaatgcctcgccctgcttcggctcgcgcacggtgcgcgcacccactgacctgcgcccactgtctggcactccctagagagatgaacccggtacctcagatggaaatgcagaaatcaccgtcttctgcgtcgctcacgctgggagctgtagaccagagctgttcctattcggccatcttggctccttattctcattaccttcttgagttgtggctcagacactacaacagagctccgtcacctctttctaaaagctgggaaatggttattgtcaacgccagccccattttggaggcacctggttgcaggggaccacagctagctgggtgcggtggctcaggactgtaattccagctacatgagaggattgcctgaggccaggagtttgagaccagcctgaacaacatagtgagtacctgtctctaaaaaaa

SEQ ID NO: 345920 - DNA, 943 bp, Homo sapiens
tgatttgatcataagtttttgagttttttaccttttctgtttgccaaattatatgagttatctcattaaaaccacacaaaaacttaatatgaagaatgataaaaataattacataaaaatagtgaaattagctgagaaaatcttgccctcaagttggaagatgttatctctgagtaccttgaaaaagtgcattttcttttgcttactgataacaggcaaataatccagttaaataaagcactgtaaaactagtgtgtgcaatttctggcctaaatacagaaaaaatagtaacaggaggcagatacgtaaacagagtaaatagccataggcctatataaacatccttcttgaaccaaaaactaaggtaaaatgagctgcaacaaatggctaccaaaagatattatgtgaagtctattccataggctatttttcttcccttctttcccctccccacagctttttaaaaaaccatcatgctgattgaataattgtagagactggaaaatctcaaattgatatccttatataaaatcctgcctcagctcattagttcagaaagaaatccaaaagttcagttctctgagttgcttcaacacataagtatattagttttatgaaagattttttttttatttcataaaaccttaatacttctgccagaatcagaagtgcattgtgctctggtacaatttacatgaactttggttcccaccacctgttagctgcgcagcgttttgccaattaagctctttgagactcggctcttaaattcaattataagaccagaatcttgctgttttttctatacatcccatctgttgtttatttctgtttctacttttcatgcacttttggttttaattgaataatttttgtgttccatcttatttcctctgttttctttttagttattataaaaggtgttattatggaattgctgaaa

SEQ ID NO: 345921 - DNA, 262 bp, Homo sapiens
atcctaaccccaggtgacatgttgcctttttttcctccttggaggctactttttctcaaagttacccacttcccaggtaagaatgccggcctcctctttgttaggattcaacttagctgtgcaggcatctaagcagtgcctccttagagtcaggctcgtccaagaaccgctcccaccacctccccacacacacccacatcccccgatcctccatcccaactacattgtaatacttcagaaataaatgtttaaagcacattta

SEQ ID NO: 345922 - DNA, 354 bp, Homo sapiens
tgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcat

SEQ ID NO: 345923 - DNA, 668 bp, Homo sapiens
aaagctgatgaatttgtggtcttgtgccccctgttcctccccactccccccagtttggccctctctcaacaactctctttggtgctggaaaccccagtgattctctgccgcatactcctgtgggcctaaagcctctctagtcagtatctacgccatatagggattaagagacacctcttcctgaccatgctgctctgctctcttaatgctgttgggaccacagttagtccatccgtgctacagaacagcttccttccacagttccagtagggaaaaggcaaaagcctctttgcccttggcgctgctgcttccttctctgaggcttcgcagccccaggtcaggttgattacatcatattcttccctttcttgtctctactccatttacccccgttcatcagaatgggaagagacatatttctcccctttgtcaagcctcttacttcttccttcctttcattgtttgggattttaacttcctaatgggattttaattgctctagtagaacttaatagtgcaattatcaaatctggaacatttttacatagcagtcattgtatttgggctatgctgtcatatggaactcatttaataatctctactagacaaagtttaacaacttggctgggcataattcaagaatgacttcagtctagaaaatggcatgg

SEQ ID NO: 345924 - DNA, 584 bp, Homo sapiens
tttacttcacagtgatcaattaaaatgagaaaatgacctattagctttgaattaccagtataaaataagttgctattatacttgacatattacctttctaatgtatgtatggaattatcaatggaaataatgtggataacttagcaataattttgtaatagttgggtgacattgaattttaaaggattatcaacttagtaatttgattatggcatttctaggaatgaggtgagtctgaattggaaatcatctctagagggtgacacagcaggacatgttggtgtgcgtggtctttgcatcctactaggtggcggtatagaatgaaattaaaaattaaatgaagtctgaggtagccttagaaaacacaaatttggctggttgcagtggctcacacctgtaatctgcagtattcaatacagcatgttactgtactgagtactgtaggcagttgtaatgcagtggtatttgggtaatcttttgggactacagcactttgggaggccacggtgggaggatcacttgagcccaggagttcgagaccagcctgggaaacatggggtggccccagctctacaaaatagaaa

SEQ ID NO: 345925 - DNA, 301 bp, Homo sapiens
tactatggctctggttttctttcacagatcccatctctctttagtttctttcctacgagaacaatcattttctcctctggggacgcacagggtctcactccttaaccaagaccaacatcatgggtattattctcatcacctggtttcttggagctgcgggctcttcctggggagcagggagcatgcgcagctttgctggtctcgaaacccctagcaaccaccgccaagcactcaggaaaaagaaaaacccttctcagttttacaactgagatttgtcagttagcacgtcttaacctacgac

SEQ ID NO: 345926 - DNA, 2518 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345927 - DNA, 2494 bp, Homo sapiens
  misc_feature (28)..(28): n is a, c, g, or t
aaggctaggtacgaggctggtgttcatnggccgagggtgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345928 - DNA, 2536 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345929 - DNA, 2518 bp, Homo sapiens
  misc_feature (753)..(753): n is a, c, g, or t
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctgngggggggggggggggggggggggggggggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345930 - DNA, 1937 bp, Homo sapiens
ggcgcgcccgggccgcccagatgcgagcactgcggctgggcgctgaggatcagccgcttccttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345931 - DNA, 2546 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgctcgtgccgaattcggcacgagccatcacaagaaatgggacagcttgggtctgtaacaaagc

SEQ ID NO: 345932 - DNA, 1542 bp, Homo sapiens
tatgctgttctagaggatctcgaggagatagcaggatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345933 - DNA, 1571 bp, Homo sapiens
agcataaactattacagcataaactattacagcataaactattacagcataaactattacagcataaactattacagcataaactattacagcataaactattacagcataaactagtacagcataaactattacagcataaactatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345934 - DNA, 1240 bp, Homo sapiens
cccactccccgtacagtgcgcacagggagtgggggtgaagcgtgttctctacataggcaacacagccgcctaagtcacaaagtcagtggtcggccgcttcgaccaacatgtggtgagcattccacgggcgcatgaagtctagggtgctgcagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345935 - DNA, 1454 bp, Homo sapiens
cgcaggccagttagttcggaggggcacagaggctccatgcctcatgattgaacatgcgacctcccagcatctcctgtgtcagcaaccctgaaagctctgcaaacccctttcagggtgtttatggaggctttattatgcaagcatgattgataaaacctttggctgttggtgattaagtcagtctccagcccctcttccccctggagttcagtgcatgaggctgaaagttccaagcctcttaccatgtggttgcatggtaatcagccctcctcttgaagaaatttaggagcttgcagtcacccagtcatctcaacaacatccccaaatgcattcttaccatgctggagatcccaaagttcttagaggctcttgtgttagaaacctgcgaacctatgacataggttcgcaggccatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345936 - DNA, 992 bp, Homo sapiens
ggtgctgggtcgatctagaggttccccgacgctctctctgtggggtaggaggacagagagacagagagagcgtcggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345937 - DNA, 980 bp, Homo sapiens
  misc_feature (913)..(913): n is a, c, g, or t
  misc_feature (915)..(915): n is a, c, g, or t
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaaggttttagaaagcaggtgccttcaaagcagaaggntngcggggtgaatggggcgctccgaccacattttcagtgtggttagaaaaaaccgggatggaaaata

SEQ ID NO: 345938 - DNA, 308 bp, Homo sapiens
accgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatgtgagagcttttcctcttgttaaaggaggagggcaagacctgccaagcctgggtactcagagcctcttgagggcaattcttactcaacaaaccccagcgcctggc

SEQ ID NO: 345939 - DNA, 2641 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaataaaaaaaagta

SEQ ID NO: 345940 - DNA, 2317 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345941 - DNA, 2398 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatattgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345942 - DNA, 2438 bp, Homo sapiens
  misc_feature (2437)..(2437): n is a, c, g, or t
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccgatgagaagagtcagccagagatggtgtctcggaggcaacagagttggagtggttaggattgccgtggactgggggaaagtgaagttcttgagggggtcaattgcacaatttatttaatgggaattggaggggggttaggaaagtgctaaaaaaaacaaaaaaggggtgcggccgtttagtagaggaggagaaatttgang

SEQ ID NO: 345943 - DNA, 2464 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatta

SEQ ID NO: 345944 - DNA, 1494 bp, Homo sapiens
ggcgcgcccgggccgcccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtatttagagccccctgtaaagctaacttagcattacccttttaagttaaagattaagagaaccacccca

SEQ ID NO: 345945 - DNA, 738 bp, Homo sapiens
  misc_feature (28)..(28): n is a, c, g, or t
aaggctaggtacgaggctggtgttcatnggccgagggtgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctctgtgggtggcttgtgtgtccctgtgtgtgctgcttgctgatgcctgtgctgactgctgctagtgcacttgtgcccatgttgctgctgcacatcctgccctagactgattgttgctgctgtgatgcttgtgttgctgctgatgcctggtgcttgctgtgcttgcttgccatgactgttgctgcaacttgatgctgatgtgtgtccatgcctggtgctgtgcattcttagcacctgatgctgcttgttgtgctcctgtgcccttctgcttgccatgcctgtctgccctgactgatggctgctgacctgcttgcatgtgctgtcttgcttgtgactgtgcctgctgtgtgctccttgcctgtcaagcggctatgttgccctgtcagcctgccttgctgctggcctaccttgcttgccatgctgccatgccagcttccatgtgaaactgcttaggtgaggtctggagtgaatgacctgcatgctgcctggcatgtgttgtgagagccctgtcctgtcttccatg

SEQ ID NO: 345946 - DNA, 474 bp, Homo sapiens
aaccacccaggctgaataggtcttttttgtgaaaccttcgttagtgcaaatggtacagtaggtaaaaatggaacttcatacccaggtcttgttttaaatatgattgccatatgtacttgtgagtcatacgttatgtttctaggcagtcctgccagcaacaatgccagattaaggaaggtctccaacctgaggcattaactagagaaaataatttcttccttcagttctgtcctcacagagtactatattttgaaaataaaaacaacccatatgcccatgtggatcacacagcagtgtgcattgctacaaaagcaaatgttcccaaaaacttatagaccatatttgaaggcagtcttcctgatctcctgatggttgctctaaataatataattggaccatcactaatgccatttgatttaagcaaaactaatccttgaaatccaaaaagatttctgaagttccctttttagagac

SEQ ID NO: 345947 - DNA, 224 bp, Homo sapiens
tttaataaaaaaaaaaaaaaaatttaagaagagttgcaaagagcataaagaattcccctctactcctcattaaatttccactattgttaacattaccaagaagttgacattggtgcattgttattaactatattcattgaaattttagcaatttaccaatggtcagatgttacatttgcaaaacagatttaaaattaagaagagagaaaagaaaaggggttggc

SEQ ID NO: 345948 - DNA, 424 bp, Homo sapiens
cttttttaggttcccatgcagctgtgtccatctggggtctggtcacctctgggaggctcctgtcagagacctacaatatggagaagggaggagccctgtttcctggaggaggaagggcccccaggcctgtccctctcagcctggctgctgtgagaatcccccagagacttaaaaaaataacctgtctgggccccaccgtaggccaaatgaaattggaatctctggggatagagcctggtaataggtatgtatttcaactttctagattattttaaatgcagccaggattcacatcaagtgtcctaggacaaaggcctcctgggagaaaacacatgtccttcttctcctcccaaaggcagccagaaaggataaagaaatgagcaaacaaggcactaatttcttcatttctcaatgtctaagcctg

SEQ ID NO: 345949 - DNA, 1198 bp, Homo sapiens
caatgcaccgctcacggcgtcggttgcccgggcaatgggccgcacgctacgaggcccacacacccagaaggtggagccccggccgggttacgaggaccacccagctgtctggagagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcaggagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttcccagggccctcagaaagcccttcagagttgttactcacaggcaggctgagggattccttacggggtctgcagctctcctcacctcatccacaagtaggaccgtggcctgttcctcactactgccccaggatcactctgttcccagcccagtccagcaatcacttgtctagctttctggaaccttgagtactttcttgaaccatgagtcctgtgaccaccctagcagctctaaccctcccttatctgaaaggaagtgtgaggtgaccttgcaggtcccagagttgattgaagaccccatccagaaagaaggcaccctgtgggagagattgcaaggcctaggtctgaatccggaagcttccaccccatggagaagggctggcagtggagctgagctttggagccaaggactgtactgcagtgcagggagagtgaggccagaaaggctgagacaactcagggaaagaaaacctcccttctggctaatagtcaagcaccgcctgagtagaccaacactctcctgtccacaggggcagcagatgaagacacaaccagagaggactaacaggccccctcagctctcagtcagagggcagagcaacacagaatagacattaaaggaacagactttgaggccaggcagccttgggtgtgcatctgtccctactaagccatgtgacattaaacaagtgagtccacctcaaaaaactca

SEQ ID NO: 345950 - DNA, 824 bp, Homo sapiens
catagcaaaagcacacaagcttgtgggaaaataatttggcaataagcagcgagaaccatacaaataccatgttctctagctcaagactctgattgctgggaatttaccctgatgaaataacccgaaagaaggggaaaaccactcagggcaagggtgtggctctggagttacgtgctttgccttgacggcactagaaagcaaagttccgaggactgtgttgcaacttggaagcccgcgcaagcagctggaaggggtgctgtgattacagccgcgtgaaggcatgcgcgctggggcctggccagcggggtgcctggagaggtacctggtccatccctccaggccccttagagagaggactcagagaagagactgagggagatgggatgtgccagggtttcctgctaggagcctcatctttctaccccttctctgttcccgagaacacagtggtcatcccctctggaagatgaagtaacagggcaccatcttggaagcaaagagagcagccctcgccagactccaagtctgctggagccttaatcttggacttcccaacctctagagttgtgagaaaataaatttctatttataatttacccagtccatggagttgtgttacagcagcacaagtggactaagacgctgtcaacacttaatttctgttgttatgccatcgtagtggttgtaaactgatatcacgttgtgattttgatttgcatttccctgatgattagtgatgttgagcatctatctgttcatgtgcttgttggccctttgtgtatcttctttgaataaatgtctattcaagttctttgtccattttt

SEQ ID NO: 345951 - DNA, 566 bp, Homo sapiens
  misc_feature (45)..(45): n is a, c, g, or t
ggttggattaattgtaattttaatgtcacataatgatcctatggnaaagggccttagagtgcctcggtacctaccctcttagccccttagagagaggactcagagaagagactgagggagatgggatgtgccagggtttcctgctaggagcctcatctttctaccccttctctgttcccgagaacacagtggtcatcccctctggaagatgaagtaacagggcaccatcttggaagcaaagagagcagccctcgccagactccaagtctgctggagccttaatcttggacttcccaacctctagagttgtgagaaaataaatttctatttataatttacccagtccatggagttgtgttacagcagcacaagtggactaagacgctgtcaacacttaatttctgttgttatgccatcgtagtggttgtaaactgatatcacgttgtgattttgatttgcatttccctgatgattagtgatgttgagcatctatctgttcatgtgcttgttggccctttgtgtatcttctttgaataaatgtctattcaagttctttgtccattttt

SEQ ID NO: 345952 - DNA, 618 bp, Homo sapiens
ctttcctgtgtttacacccacctgcagcgtggataaagagtttctggccgggcgaggtggctcacgtctgtaatcccagcactttgggaggctgaggcgggcggatcacgaggtacctggtccatccctccaggccccttagagagaggactcagagaagagactgagggagatgggatgtgccagggtttcctgctaggagcctcatctttctaccccttctctgttcccgagaacacagtggtcatcccctctggaagatgaagtaacagggcaccatcttggaagcaaagagagcagccctcgccagactccaagtctgctggagccttaatcttggacttcccaacctctagagttgtgagaaaataaatttctatttataatttacccagtccatggagttgtgttacagcagcacaagtggactaagacgctgtcaacacttaatttctgttgttatgccatcgtagtggttgtaaactgatatcacgttgtgattttgatttgcatttccctgatgattagtgatgttgagcatctatctgttcatgtgcttgttggccctttgtgtatcttctttgaataaatgtctattcaagttctttgtccattttt

SEQ ID NO: 345953 - DNA, 558 bp, Homo sapiens
tcaactgcgagatcctctatctagaatatttaatataaaaaaaaacccttgagtacctggtccatccctccaggccccttagagagaggactcagagaagagactgagggagatgggatgtgccagggtttcctgctaggagcctcatctttctaccccttctctgttcccgagaacacagtggtcatcccctctggaagatgaagtaacagggcaccatcttggaagcaaagagagcagccctcgccagactccaagtctgctggagccttaatcttggacttcccaacctctagagttgtgagaaaataaatttctatttataatttacccagtccatggagttgtgttacagcagcacaagtggactaagacgctgtcaacacttaatttctgttgttatgccatcgtagtggttgtaaactgatatcacgttgtgattttgatttgcatttccctgatgattagtgatgttgagcatctatctgttcatgtgcttgttggccctttgtgtatcttctttgaataaatgtctattcaagttctttgtccattttt

SEQ ID NO: 345954 - DNA, 1895 bp, Homo sapiens
  misc_feature (1892)..(1892): n is a, c, g, or t
  misc_feature (1894)..(1895): n is a, c, g, or t
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccataggtttttcatttctaacaaccagatggccccacctggacctgccaaccagttctgtggcccccacctaggaactgactcagcagaagagaacagcttcgattccccatgcttttactcaccaaattatccttaaaaactctgatccccaagttttctgagactgatttgagtaataataaaactccggtctcccgcanann

SEQ ID NO: 345955 - DNA, 2853 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagcaccttacagaatggagaaggccctggagtccatgcccctaggatggggtgagggagtatcactctgtggggtttcacagcaccctggatcctgccttccagcccctgccaagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345956 - DNA, 2718 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345957 - DNA, 2895 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctggggcttgaggaccgacagtgggccgagtcggggctgggagttagaatctgagttctgggtgtccctctgtccctgacaagttgtgtggcaaggttgccgcatcactgtagagcaccggatggtctcctctcggtctcacagctcctccttttccaggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345958 - DNA, 2360 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345959 - DNA, 2080 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcaggtgggttctggggaacaatagtcaggagggctgggggaggggaagatactagctggcagtggaggcttccacacgcccccaggttcagaacctttcctcaagaaaaaacagcacaaactctggtacagaaagcagcagccagctgtggtagctcacgcctgtaatcccagcactttgggaggccaaggcggccgggtcccttgagtccaggagttcaagaccagcctgggcaacatagtgaaaccccatctctacaaaaaatataaaaattagctgggcgtggtgacatgtgcctgtagtcccagctactcgggaggctgaggtgggagaatcgcttgaacccaggaggtgggggttgcagtgagctgagatcgggccactgcactccaatctgggtgagcattttggacttcccaggcagctgtttgcggtagttcccttaagtcacaggcattttactacactggagcgtgttttcgcgtatagatccctgggtacaccgtcttggtc

SEQ ID NO: 345960 - DNA, 1832 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaactctcaggggcgaataaatttttaaacaaacacaccccaaccaacacaccccgcccttttttttaccccccacggaaacacaccgcaccacaacaccacccccccccatctaggcggcggggcgccaaacaaacctcacgcacacgggacccccgggggggcgcgcccaccgtcttctcccgccacgcgggcggggagcacgccccaccgcgggcgccacccccacccactttctcccccccccaccccacccccaggg

SEQ ID NO: 345961 - DNA, 390 bp, Homo sapiens
ccactgcactccaatctgggtgacagattttttgaaacaaattcccaaggcaagcctggttagagaacggcatagtctcccatcaagtccaacacggccatttcttccttcagccttggaagtctgtttcttctccgattatgagaagtcatcactggcttaaaatccagggtatacgggttgagaaacccatgcttcctctgagtacctgtagttcagttgtgacgctaccatgcgggacccagtcactgaatcactgcactgaggttcctgtgctttcactgacatctttgcgtgaagccaacttagaaataacttgtccaacctcatctttttgcggaggctccaactgggggagtcctgtgtctgttacaagtcaagtttgggccc

SEQ ID NO: 345962 - DNA, 2740 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345963 - DNA, 2659 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttgcagggttaaggcccccgggggatcctctacg

SEQ ID NO: 345964 - DNA, 2694 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgagtgaggaaagtcccgcggagatttttcaaccagttatgtagcagatttgctcgattgcgggggggggctttccaaaccaacgggttgcctgttgggtttaacgtacataccttgtttcccaagaaaaaaaaaacaaacaccaacgag

SEQ ID NO: 345965 - DNA, 2474 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345966 - DNA, 2587 bp, Homo sapiens
cggatttttatgagatataattacattgacatgacgcctcatgatttacccatgactcggggggtttccaaactccaaacacctccagactggagcccgtcaatcagcttcctcttgcttttcgtggactcccactgtggaaacctgctggtgttttgctgcggtttcatttccctctgcggaggagccagggcaaccttggccagacaggcacctagctgtgcccttctttccagggcctcttctccactcagctgactcccctggcctgcctaacgctcctgactgagacggttttccggcttcctctaacaggttggcgggaagttgatctgcaaacgcgaggcaaagcaggagtgtccttattcggtaggcctctgatgggccaccagagccgtccgaaagtcctagcggagtgattgacagtggccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttctcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggctggcgccttcctctgttgggccagcggtacctggacctcctgaccacgtggtactgcagcttcaaagactgctgccctagaggggattgcagaatctccaacaactttacaggagcagctgatgagccagatccgggagacgcagcagctctgccaccagaccctgttcatcttcgatgaagcggagaagctgcacccagggctgctggaggtccttgggccacacttagaacgccgggcccctgagggccacagggctgagtctccatggactatctttctgtttctcagcaccttacagaatggagaaggccctggagtccatgcccctaggatggggtgagggagtatcactctgtggggtttcacagcaccctggatcctgccttccagcccctgccaagtaatctcaggggcgatataatcaatgaggtggtcctaaagttgctcaaggctggatggtcccgggaagaaattacgatggaacacctggagccccacctccaggcggagattgtggagaccatagacaatggctttggccacagccgtcttgtgaaggaaaacctgattgactacttcatccccttcctgcctttggagtaccgtcacgtgaggctgtgtgcacgggatgccttcctgagccaggagctcctgtataaagaagagacactggatgaaatagcccagatgatggtgtatgtccccaaggaggaacaactcttttcttcccagggctgcaagtctatttcccagaggattaactacttcctgtcatgaaggctagaggaagacttcctggaactgcctttcttccactaacaggaccctgggacctgtaggagcaccccgtttgggactgtgaggtgtttgagggtgtggactggcatccagcagccactaacaaacacacaactggtgtgtaaaaggcaggccttacattagaagccaagccaatcctttttcttttttttggaggtcccaccgagatagataggaacttggattgctgaattcaaaaacagagcccattcttaagatcacttggtgccttaaagacacgcattccaaagtggaatgtggttgaagaaagtgggccaggtggttgaagaaagccatgtgggagctcagcaaatcccaagggcttattatgacactccagatggtctccttagcatctcagctcttctgcaaggaagagcttgggtgttaggcctcagaggctgtagggtccttgggttacagagccggggagaacgaagttctgtgacccaggggtggagaatacactctaggtttgcgggctggtgggctttcaaattggtacttccagaggaaagccaagctgcttctgttgtgagcgaatcagccaagagcctgaggctgaagggaaaagtacacagaggaagatattttacaaaccaggtcagtgtaggccaagacttatggtctacagattttggcgggggaggggggaccttttcaaagacaatagggggtcttgacatgtttgttgtatgtaaagatgataagattaaaatttttgattttcctaaaatccttggcgtactttc

SEQ ID NO: 345967 - DNA, 401 bp, Homo sapiens
agttttgggggagccaaaagttaaaaagtagattttcaactggggcattggtgtccctaaatcctaagttattcaaaggtcaactatagttggaataatatattatgtagctttttcagactggtttatttcactcagcaatatgcctttatggttcctttatgtcctttcatggtttgataactcttttcttttcattgctaaataacatcccattgtatagatgtagtacagtttatctatccattcaactactaaaggacattttggttgcttccaagtcttggcaattatgaacaaaggtgttttaatattcatgtgcagatgtttgtgtgaatatgtcttaaactaatttgggtaaataccaaagagcgtgattgttgagtcataagactatgttt

SEQ ID NO: 345968 - DNA, 92 bp, Homo sapiens
ttgcttgatgggagaggaaggtttagggtgcttagctgcttcttaactctttcaacccaggcttcctatttggatgtccgttttcacccctc

SEQ ID NO: 345969 - DNA, 805 bp, Homo sapiens
ccctgctgaccttatacccacgatcaccctgttgccctgccacactcccctcgccaagatagtaaaaatagtgatcaataaatactaagggaaatcagagaccagcgctggtgtgggtcctcacacgttgagcgccggtctcctgggcccactgttctttctctgtactttgtgtctgtgtcttatttcttttctcagtctctcgtctccacctgacgagaaatacccacaggtatggaggggcaggcccccttcatctaaaaggtgttgaaagccttggactatgtgaattaacttagactgcttattggttatcctggaaatcggtaacagcagataaaattaggaaaggagatgattctgcttttaaagtagtgagtggcatgtcttaaccacagagtgcagtgattataaaattccatttgattctttgtttttctcaaattgcataagcagtgagtaggaagaagatgatgaaccacaggaggagtagtcagaaggggagaagaacgagaaaagtaatgtcacagactgtgagggaaaattatccacaaagatgggatgttacagtgtcagatgctgcagaggaggataggtgaagaaagtagaacaaaatactgatggttgttgaagctgtgctgttaggtacatgggagtttattgtattagtctatctgcatttgtcatctatgggttgttttttttttgttttgtttttttgtttttttagatggagattcactctttcacccaagctgagatcgtgccactgtactcagagtgatgacagttagaccctgtgtca

SEQ ID NO: 345970 - DNA, 310 bp, Homo sapiens
tggggccggtcatggtagctcacacctgtaatcccagcattttgggaggccaagacaggaggatcacttgagcctaggagtttgagaccagcctgggcaattgagtgagacctcatctctacagaaaacaaaacaaaacagaaaaattaaaattaaaaaacggtagttaggcctggtggcacgtgcctgtagtcccagctgttggagtggggagggtgcccaaagtgggaggatcacttgagctggggagatcagtgagctgagatcgtgccactgtactcagagtgatgacagttagaccctgtgtcaa

SEQ ID NO: 345971 - DNA, 473 bp, Homo sapiens
taaggtctaggtagcaatctgtcagtgcatttacttaaaacttgtattaagcattttaaatataatttttcaaactccaaaatattccctgttaagaaacacaaaagtagaaaaacatggataaattttttttctaaatttgtatatttattacaggcattaacatgtccactccactttacaagatcttcggagaaaagtgctattccaagctccattatgctacttgacaaacagcacactatgtatatgtaaacaaccaaatatttaagccatttttcagtggtttctccctagccacagacataaagatatgtgcttgtctttagtccaacattatttccagagaaaagtaaaacaggctgggcatggtggttcacacttgtaatcccagcactttacaaggttgaggtgggaggacttcttgaagccagaagtacaagaccatcctgggcaacactgcaagacgcagt

SEQ ID NO: 345972 - DNA, 686 bp, Homo sapiens
gcgaatgtttatacgatgctgagcacatgtacagggctgacacacaggaagcccaaagtggtaaacaatactaaaataattaacaccgaccctttgaaactgactaaaggaactgctgaaggtcaaagagccagaagtaccaggatgtggatctgaatccaggtcagtctctctccaaagtcctttccaccacctgctgcccacattcttgctcaaaggtgtgatggtcccttaaaacgtgcttaatactcagcagctgagtggccacccactataccgaactgggccagctgtggggcttatccagaagctcctcaagttctttgaacttctccctttcctcagtcccagactactcttcatgactattcagagggtccagaaatcactggaagtgtttcagaatttcagggttagaaaaagttttcaaagacccttgaaatgaacttccttctaatgcctgagtctctgctgagaccacgtgtctgggcaagaggctgtcctatctgtgtgaacatcttcaatggcaaagaacttggcacctctaagtgcagcccatttccgtgcagcaggacccactgctagtaagttcttcatcatgaaatagaatctgttctctgtatttttcagtcattggtcctgattctacctgccatgtcatttttggtcttttcacctccagccta

SEQ ID NO: 345973 - DNA, 350 bp, Homo sapiens
tcacgaaggccgtggcagaggaaaaaaaaaaaaaaataacatgagttctggttctggaaaagtatccctatcgagaaagctgtacctttttaatatgatctcagtggcatctttctttcagtgtctttcctatgcaataaatatcttgcctttttcatatgtaaatggcacaaccctcgggtcaaggacaaaagtgtgcatttcttttttcctccagagttgctgggttgttttgtccaatggtaccttctacagcatttctccaagcagcttggcaccgttagtaccaagctctcatctgtgtgcttaaaaaaaggtggggggagcctatgtgatttaggttttttgtt

SEQ ID NO: 345974 - DNA, 5249 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345975 - DNA, 6126 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctggccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345976 - DNA, 6059 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcaccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345977 - DNA, 5891 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgactcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345978 - DNA, 1312 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctctgcaggatgtgcaccagggcagatgccatctcctccttggtcttggcaccgaggatgggctcgagggctgcacacagccccaggtagtggttggtgatgtgctcagcgaactctttgtacatctccatgggcaggatggtgatggtttggtaacgcac

SEQ ID NO: 345979 - DNA, 6383 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345980 - DNA, 6146 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345981 - DNA, 6341 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagcccccctgcccagccctctgcagtttctaaaagaggttcatccataccaattctcagcatcattctcccattaggctccccccctaacccattctttcttatgaccgattagtaatttgcaagagaattcttcctcttactcataccatccactcagacatctccaatcccgggatcctctagatcga

SEQ ID NO: 345982 - DNA, 1867 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgcccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaagcccga

SEQ ID NO: 345983 - DNA, 368 bp, Homo sapiens
aaggagcctgtcccatgacccccgctcacatccccattgtccacaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgc

SEQ ID NO: 345984 - DNA, 2536 bp, Homo sapiens
  misc_feature (970)..(970): n is a, c, g, or t
  misc_feature (1664)..(1664): n is a, c, g, or t
gtcatggactggaagttaagaacttccacacaataacaaaaattatgggccagacacagtggctcacacttgtaatcctagaactttgggaggccaaggtgggaagatcacttgagcccaagagttcaaggctgcagtgagtggtgatggagccatgcactcagcctgggcgacagggtaagaccctgtctcagaattaaaaaaaacaacaacaaaacaacatacataaatacctgatttgtgtactactgagaaaagttcagttcttggggagagtttcagtttttcccatcaagaactgcgtggtattttttgttatttgtgtgtgtgtgcgcgtgtgagacagagtcttgctctgtcatccaggctggagtgcagtgatgtgatcttggctcactgcagccttcaactcctgggttcaagcgattctcgtgcctcagccacctgggtagctgggattacagacgcacaccaccacacccagctaatttttgtatttttagtagagatggggttttccatgttggccaggctggtcccgaactcccgacttttcaagtgatccacccaccttggcttcccaaagtactgggattacaggtgtgagccaccactaccagctgagaactgtgtgttcttatgctccgtgtgctacttatatctcagacaacgaccagattttttaccataccaagtaaaatagtaaggagaagggaaactgtacatatatctttttgtcttttaggaaacttttacaaatgtgattcagagattgggcatttcacaggcacacttttttctccctagtttctgctagctggaaattttctttctagcaatgtctttttttttttttttttttttttttttgagacagagtcttgctctgtcacccgggctggagtgcagtggcacaatctcggctcactgcagcctctgcctcctggattcaagtgattctcctgcctcnttcccattttacagatgaagaaaacttgttcaaggtcttgtacccaggtctctctgacagcagtctcttgctattatttataaatgtctattgctgtaaatgccaccatttagattttagtgtcaaaacagaaccatagcagttcacatcttaatcagacattgtctgttagctgcatgagtggtggcctcattcagaaaagaaagaatgtgttattattgacctagttggactcagaggaagagattgggtctttagccaactggagtaatccttttcctctcttagagagaagcttggtcagagcaagactagcatttttggcattgttgaggttttctgaaaatcctatactaatgggaatctttatttgttgttaacattataatttctaaagtggagaagaagtaggaaactctgcaaatattttagagggggtaaagttcccatgacagtacattttagcatctgtttgaaaggaacctaaaacaacaaagtataattggctggctgacagcgaatttctgtgacctaacagtttagatgtaataattgtgaaataactgctctattagaatctttagagagagatttcaagaatcatagtaaacaggttataaaggctatgtcctaagtaatggtactgaaagaatttttcattagaaccataggcataatttaagacaaaagaganggtaatggtagaaaagagataaaagaattgaaaattgtgactgatgttagcagccttgaatgtaccaaatgaccaagggtatcagaagagagattggtaaaaataataggttctaagaaattgattataaaataggatcctaagcagaaaaaatgcatcctgagaatctctagtaccccattatgttcttcacttagtagtatgccatttctcctcttttcactaattcttttcccccttttttcccctacagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggtaaggggcaagacattgtcaggcttaccccagctaatgggcatggcattaggggagacaaagttactctattccctgctacacttgggtattacttgtttctcttcttgtggctaaaggctcaccaacaaagacttaatttcacctgaataaatgaaatttaccatgtaggtagattttacttgaaaaataatttaaaattgtacaatgtctggtttgaaaattatttattgtggtttttgggaaaaagtgttttctgcttttattatggccttcacatcctaggattcaaatttgaatgtgatagctggcacacggagggatttattcaaaaatggcctgaatcacgttgagcagccagcagaacagagcttaa

SEQ ID NO: 345985 - DNA, 797 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggtaaggggcaagacattgtcaggcttaccccagctaatgggcatggcattaggggagacaaagttactctattccctgctacacttgggtattacttgtttctcttcttgtggctaaaggctcaccaacaaagacttaatttcacctgaataaatgaaatttaccatgtaggtagattttacttgaaaaataatttaaaattgtacaatgtctggtttgaaaattatttattgtggtttttgggaaaaagtgttttctgcttttattatggccttcacatcctaggattcaaatttgaatgtgatagctggcacacggagggatttattcaaaaatggcctgaatcacgttgagcagccagcagaacagagcttaa

SEQ ID NO: 345986 - DNA, 6090 bp, Homo sapiens
  misc_feature (970)..(970): n is a, c, g, or t
  misc_feature (1664)..(1664): n is a, c, g, or t
gtcatggactggaagttaagaacttccacacaataacaaaaattatgggccagacacagtggctcacacttgtaatcctagaactttgggaggccaaggtgggaagatcacttgagcccaagagttcaaggctgcagtgagtggtgatggagccatgcactcagcctgggcgacagggtaagaccctgtctcagaattaaaaaaaacaacaacaaaacaacatacataaatacctgatttgtgtactactgagaaaagttcagttcttggggagagtttcagtttttcccatcaagaactgcgtggtattttttgttatttgtgtgtgtgtgcgcgtgtgagacagagtcttgctctgtcatccaggctggagtgcagtgatgtgatcttggctcactgcagccttcaactcctgggttcaagcgattctcgtgcctcagccacctgggtagctgggattacagacgcacaccaccacacccagctaatttttgtatttttagtagagatggggttttccatgttggccaggctggtcccgaactcccgacttttcaagtgatccacccaccttggcttcccaaagtactgggattacaggtgtgagccaccactaccagctgagaactgtgtgttcttatgctccgtgtgctacttatatctcagacaacgaccagattttttaccataccaagtaaaatagtaaggagaagggaaactgtacatatatctttttgtcttttaggaaacttttacaaatgtgattcagagattgggcatttcacaggcacacttttttctccctagtttctgctagctggaaattttctttctagcaatgtctttttttttttttttttttttttttttgagacagagtcttgctctgtcacccgggctggagtgcagtggcacaatctcggctcactgcagcctctgcctcctggattcaagtgattctcctgcctcnttcccattttacagatgaagaaaacttgttcaaggtcttgtacccaggtctctctgacagcagtctcttgctattatttataaatgtctattgctgtaaatgccaccatttagattttagtgtcaaaacagaaccatagcagttcacatcttaatcagacattgtctgttagctgcatgagtggtggcctcattcagaaaagaaagaatgtgttattattgacctagttggactcagaggaagagattgggtctttagccaactggagtaatccttttcctctcttagagagaagcttggtcagagcaagactagcatttttggcattgttgaggttttctgaaaatcctatactaatgggaatctttatttgttgttaacattataatttctaaagtggagaagaagtaggaaactctgcaaatattttagagggggtaaagttcccatgacagtacattttagcatctgtttgaaaggaacctaaaacaacaaagtataattggctggctgacagcgaatttctgtgacctaacagtttagatgtaataattgtgaaataactgctctattagaatctttagagagagatttcaagaatcatagtaaacaggttataaaggctatgtcctaagtaatggtactgaaagaatttttcattagaaccataggcataatttaagacaaaagaganggtaatggtagaaaagagataaaagaattgaaaattgtgactgatgttagcagccttgaatgtaccaaatgaccaagggtatcagaagagagattggtaaaaataataggttctaagaaattgattataaaataggatcctaagcagaaaaaatgcatcctgagaatctctagtaccccattatgttcttcacttagtagtatgccatttctcctcttttcactaattcttttcccccttttttcccctacagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccctaatcataaataatagccccttgaggacta

SEQ ID NO: 345987 - DNA, 1915 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggaacaggtcaccaggaaagaatatgagaaaggattagagatctgagttcctgacgaggagtggcgtataagacggatgttgaatcgatgccaggatttctaggggcactctacacaaagacttgatgtgtcagctcagagagtgataaccggcaccttgtgagataggagggcaacaatgcatggagaagcaatcagtcagcagagaagcacgacaggcaga

SEQ ID NO: 345988 - DNA, 1174 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccatgtcttttctacttccttgtaaataggtatgatcttagttcccactgtacagtctgttctatcctctgcctcccatcaggccctgtttctttgttcctttgttaatatcttgaatttagtccctccatcttgagcctgtgtact

SEQ ID NO: 345989 - DNA, 4351 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccctaatcataaataatagccccttgaggacta

SEQ ID NO: 345990 - DNA, 2330 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactca

SEQ ID NO: 345991 - DNA, 2656 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcaagaaaagaaaaaaaaaaaaaaaaaaaaaaaaaaaaatatgtaaaaaaaaaacaagaacaaaaaaaaaaaaaaaaaagaactatgggttgggggaggccgacgcgtcgacgagacgcccacaggaaggaagaaagctctaatgaaaagaaaaacaaatgctgaaagagagggcgagagcaggcgggcacccccaacgcaggaggggaagcgagagaccaaaagcagggggacgcacgcaaatcaggggtcacaccccagagaggaggcgaaaacgagcgagggcaacagcacaaaaaagggagcgagaacgcagtaggccgaaccgc

SEQ ID NO: 345992 - DNA, 4260 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccctaatcataaataatagccccttgaggacta

SEQ ID NO: 345993 - DNA, 4518 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggtaaggggcaagacattgtcaggcttaccccagctaatgggcatggcattaggggagacaaagttactctattccctgctacacttgggtattacttgtttctcttcttgtggctaaaggctcaccaacaaagacttaatttcacctgaataaatgaaatttaccatgacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccctaatcataaataatagccccttgaggacta

SEQ ID NO: 345994 - DNA, 2728 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcaggtgagcttacagttctcccttttataattcagctactggtcaattctactgggaaacataggaatcttgagcataaaatcagcatctcagtgtcaccttaccttaggtagagtaggttgctgtatctggtctactagaaaagctcccctgcttaagagcttacatttgccacataagccaaagatgatgtaatcagcagttcacatttttcagttaccacatacctctcttatgtatgctctttaaaaatataatacattaagctgttagtgtttgcaaatattagcttttcaattcttggtgcaaatcagactacttagggaactagaatttggggagaaatggtaagtggaaagtaacacataataatttgcaatttgtgaaggaaatggggagatggttggaatattttacccctctccccaaattttcctgggaatttcctatagctgtaggacaaggcatttctatttcctatttcaaaaactctgcagtaaattagcattgcctctacttctgacttttaagcccactgttcttatattttcaaggtgatactatctcaccataatgctgtaggaaattatctgggaacctatttgtttaagacagataaaaaatccagctgggccatacagtgaaaccccatctctactaaaaatacaaaaattagccgggcatggtggcaggcacctgtagtcctggctactcaggaggctgaagcaggagaatctcttgaacctgggaggtggaggttgcagtgagccaagaagatcacgccactgcactccagcctgggcaacagcgagactccatctca

SEQ ID NO: 345995 - DNA, 3616 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccctgccctgtccccatccattgttgttaactccaccctttcatcctatgtggcaaaccaggcatcttctggagctgggggtcagcccaatatcaccaagttgattattaccaaacaaatgttgccctcttctattactatgtctcaaggagggatggttactgttatcccagccacagtggtgacctcccgagggctccaactaggccaaaccagtacagctactatccagcccagtcaacaagcccagattgtcactcggtcagtgttgcaggcagcagcagctgctgctgctgctgcttctatgcaactgcctccaccccgactacagccccctccattacaacagatgccacagcccccgactcagcagcaagttaccattctgcagcagcctcctccactccaggccatgcaacagcctccacctcagaaagttcgaatcaatttacagcaacagcctcctcctctgcagatcaagagtgtgcctctacccactttgaaaatgcagactaccttagtcccaccaactgtggaaagtagtcctgagcggcctatgaacaacagccctgaggcccatacagtggaggcaccttctcctgagactatctgtgagatgatcacagatgtagttcctgaggttgagtctccttctcagatggatgttgaattggtgagtgggtctcctgtggcactctcaccccagcctcgatgtgtgaggtctggttgtgagaaccctcccattgtgagtaaggactgggacaatgaatactgcagcaatgagtgtgtggtgaagcactgcagggatgtattcttggcctgggtagcctctagaaattcaaacacagtggtgtttgtgaaatagtccttcctgttctccaagccagtgaagagttatctgctgggaaagtgtccaagagcctgtttttgaaacacaagctgggcttctggtagtgcctcatcacaacccatgatggctgttcatgtttcaccccttttcttccttcagcagaggccaggctatggagcagggccactgaatttgctgtaatctggagatgctttttactttcaaccataagcggtaatagcagaggaaagggtgaagggagtctgggcaagcaaagcatagagatggtggggtggtggtggggttgaagaaacttgttggtataattgtcataggacttgcctaaaatattattaaaattacgggagtgtactcagctttgagcctaggagaaaatgccactgtgtgcatccattttaaagggttccctcataaaaaaatgttattccccattatcacatcagtacactgctttgaaaacaaaacttttcaacatgggcatactgggctacatggaaaatgacatcacccaggagtgatttctctttatatatattatttctgcagttaccatccttatctgagttatcacagttcatgaatctaagaggcggaactctacatcattagtaagaggttccaccaaagtctaaagttgtattcacttgtgtttgatgaactatctttaaaagaccataggtctatcattatttcttagacataatctaaagaaaaacagactagagaagccacctggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgttttctgtgttttttgttttttttttttgagacagagtctcgctctgtcacccaggctggagtgcagtggtgcgacctcagctcactgaaacctctgcctcccgggttcaagcgattctcctgcatcagcctcccgagtagctaggattacaggcgcccgccactacgcccagctaatttgtggtatttttagtagagacagggtttcaccatgttggccaggctggtctcgaactcctgacctcatgatccgcccgccttgacctcccaaagtgctgggattacaggcatgagccaccgcacccagcctgcattcctgtttttttaatggttttggagggtagcagtagagatggggtctcactatgttgcccagtctagtcttgaactcctgggctacagttaccctcctacctcggcttcccaaagtgctcggattacaggtgtgagccactgtgcctagcctataatgatcattttaatgtttcccatgcactcatttagtttgaaccttcacagcaacccaatgaggtaatactcccatttcacatataatactgagagatgagttgcacaagattatacactgttaagtagcagagccagaatggacttcagaatcccaactacaatacaaatgtttatttaaataaagaagaaagctattgtacaaatatcactcttcaggtttagcttacagagccatggctatggattcttagctctgtaaggaagtgcttctataaattcttaggtttagagatgataccatctgggtacctttgcttgaaccgtgcaaccacatctgggtctagtaggtggatcccatccagttggtttccaagggtgatcctgaaacagtgtaaaaggaggggcaaaccagaaatcctggaattagagggtttaatattgttaaaaaatgcataccaaatgaagactgcctatcatcatatcaaatatgccaattctaaaaagagcttaacattagaatagtatatggtagaattactagttcagaattggcatagattctggtgttaaaatagactggatctgtattatctgagggttagtaactaatgcttagccaggcctgcttcacagagttgctaccagggagtattctttggataagcaaaatgctagcagcatgtgttttaagctctgttaaggggtgaaagatgtaattattgacagattaaatagataacttcgtaaccaccagggggcagattcaatacatcacagaatggctgaggaagatccttgggttgtgaagagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccctaatcataaataatagccccttgaggacta

SEQ ID NO: 345996 - DNA, 1204 bp, Homo sapiens
agcagagagaacacacgtccttgcggaagtgacggcagttccgagtccagtgggggcggtgggagcgatgagggtctgagacggtgggagcggttgtgtgaagatggagtttcccggaggaaatgacaattacctgacgatcacagggccttcgcaccccttcctgtcaggggccgagacattccatacaccaagcttgggtgatgaggaatttgaaatcccacctatctccttggattctgatccctcattggctgtctcagatgtggttggccactttgatgacctggcagacccttcctcttcacaggatggcagtttttcagcccagtatggggtccagacattggacatgcctgtgggcatgacccatggcttgatggagcagggcggggggctcctgagtgggggcttgaccatggacttggaccactctataggaactcagtatagtgccaacccacctgttacaattgatgtaccaatgacagacatgacatctggcttgatggggcatagccagttgaccaccattgatcagtcagaactgagttcccagctgggtttgagcctagggggtggcaccatcctgccacctgcccagtcacctgaagatcgtctttcaaccaccccttcacctactagttcacttcacgaggatggtgttgaggatttccggaggcaacttcccagccagaagacagtcgtggtggaagcagggaaaaagcagaaggccccaaagaagagaaaaaagaaagatcctaatgaacctcagaaaccagtttcagcatatgctttattctttcgtgatacacaggctgccatcaagggacagaatcctaatgccacttttggtgaggtttcaaaaattgtggcctccatgtgggatagtcttggagaggagcaaaaacaggtatataagaggaaaactgaggctgccaagaaagagtatctgaaggcactggctgcttacaaagacaaccaggagtgtcaggccactgtggaaacagtggaattggatccagcaccaccatcacaaactccttctccacctcctatggctactgttgacccagcatctccagcaccagcttcaatagagccccctgccctgtccccatctctgctaaaattacaaaaaattacccagacatggtgccctgcactccagcctgggcgacggagcaagactgtctcaaaacaa

SEQ ID NO: 345997 - DNA, 845 bp, Homo sapiens
acaggcgtgagccaccacgctggccgataattttgatttggtatatctgccctcctcctccattgggtgaaagttttttgagagtaatatatgatgttgacatatgaagcctgcctcccaaagtgcctaggacaagtttttattcttgactgcttgtcttttatttccttattcccagtacctggtggagctcttgattcataacaagtgctatgtaaatgctaattgtatcaattaatattactgcctacttggagcttcaagtctaatttgaggaaaataaagagcaacagaaaagagaacacttggtccaacacataaaaagggtgataatattttagagagtttgggtagacttgaatattatttgtttagaacctgaatctcaagtctaagtctgtaacaagatttctcttccagatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 345998 - DNA, 2344 bp, Homo sapiens
gcacgagtcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 345999 - DNA, 2812 bp, Homo sapiens
gcacgagtcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaaaaaacaaaaacaccaaacacacacaccacaatacaaacaacaacacactaaaaaacaaataacatcagccactaaacaataagcgcgggccgctccataaaaatcacacccagaggggaccaacagagccgagaaagtgaccacatttactaattaataaagaagtgggccccacctagcggacgtctctctataaaagcgagagtgacgcgcccggtgtaaaaaccaacgcacggggacagcagagacaaactatgtctcctagtggtgcatcacctttgagaaggaacacacatcatacggcgtggcggagacacacatataggaaaccacccctcaacgcaggtaataagtggccaggagggaacatatacagctcgtgagaggcatattaggggagcagccgaccccgctaccctctgcccggcgtcaaaaattatccatggcggattctgtgaactcatcacg

SEQ ID NO: 346000 - DNA, 584 bp, Homo sapiens
ccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttgctaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346001 - DNA, 844 bp, Homo sapiens
  misc_feature (575)..(575): n is a, c, g, or t
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggttgagtgagccgagatcgaccattgcactccagtctggcacagagtgggattccgtcttaaaaaaaaaaaggaaagggaaaaaaaatagcattatacctcttcctggttcangcgcatgaaaattttgaacactccaaattccgtggaataatccaaaaaaaatttttaggttttacaatattacttcttatagtaatagttacttaaaaagcctcagggtattttatttttaaagctacaattcagtggattcattaacaataggtttttgtgtgaccactaggctattcaggggtgccagggtacatggtgggaaaatttgtgaatacaggatgataacacgcttgtgtatgggagatcaaggcggttgggtggaagta

SEQ ID NO: 346002 - DNA, 2376 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346003 - DNA, 2472 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggagttccaggaagcgctcgcccctggccgaggatatgtccttgcaaaacacgagccctcctagtgaagaggggatgtcacccaaagcctaccaccggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346004 - DNA, 2339 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346005 - DNA, 2229 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346006 - DNA, 2024 bp, Homo sapiens
cttacaggcgtgagctaccacgcccagccaattattttcttttttggggggtgggggatggagtcttgctctgtcacttaggctggagtacggtggcgcgttctcggctcactgcaacctctgcctcccgggttcacgccattctcctgcctcagcctcctgagtagctgggactacagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346007 - DNA, 2647 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataatatgctaggtctctgcttctgtgttttttggagtagaaggccctaagatgtggttcctgagattgcttcaactaccacattaatgtctgagctcagaggttctttctaccccatcatcttccacagttctggcaaaattattcttctctgtttccaggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346008 - DNA, 1562 bp, Homo sapiens
cttcctgcttctgcctttggttatgttcaccagcttctctatgcttcctgcttctgcccctgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346009 - DNA, 1647 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcacgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346010 - DNA, 1309 bp, Homo sapiens
agaattacttgaacccaggaggcagaggctacagtgagctgagatcgtgccattgcactccaacctgggtgacagagtgagagagagaaaaaaatatatatatatatatgtattcttactgctttggtatactaatatctctgcctgacagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaagtaagtgccatgggattgggtggaaacctcgggcaagtacctttcccaaactcttctggggggtccatatttggagggaggggagagttctccgttgctctctctttccctcagccctgcctctgatcttcaatgcctttctcacttgtggatgtccttcctgtcacgacagagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346011 - DNA, 1106 bp, Homo sapiens
ggggtttcaccatgttggccaggctggtcttaaactcctgacctcgtgatctgcccactttggcctcccaaagtgctgggattacaggcatgagccaccgcacccagccaagtaatcctatattataagagtctaagggtctagaggacaaaaagtctgtaggtctttacattgtcaagaacaatgagattgtaagtatttttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346012 - DNA, 2242 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctctcctgaaagagtcctataggtagccacg

SEQ ID NO: 346013 - DNA, 1377 bp, Homo sapiens
ggggtttcaccatgttggccaggctggtcttaaactcctgacctcgtgatctgcccactttggcctcccaaagtgctgggattacaggcatgagccaccgcacccagccaagtaatcctatattataagagtctaagggtctagaggacaaaaagtctgtaggtctttacattgtcaagaacaatgagattgtaagtatttttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataatatgctaggtctctgcttctgtgttttttggagtagaaggccctaagatgtggttcctgagattgcttcaactaccacattaatgtctgagctcagaggttctttctaccccatcatcttccacagttctggcaaaattattcttctctgtttccaggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346014 - DNA, 1584 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaagtttgatgcggatagctttgaggggatcctgctagag

SEQ ID NO: 346015 - DNA, 637 bp, Homo sapiens
gcgcctatagtcccagctactcgggatgctgaggcaggagaatggcatgaacccgggaggcagagcttgcagtgagccaagatcgcaccactgcactccagcctgagtgacagagcgagactccatctcaaaaaaaaaaaagaaaaattaagtataatattttgtgtaggttctgttaggtttgcatgcattatttaagtggttaacactagacctgtaaggtaggtactgttttcttcccccttctagacacttaggaggtttagagactaagttccttatccaagataacaaaggcattaagtggcagagttaagattcaaactcaggtttctctgactccagagtctcaatcatcacactatattactacctaatatgctaatcttgctttaggaacatgggttgaaaaattccagtgctcacttatcttgactaaattttttgcactgtggtgcaggcagaatgtggtatagtcattcaaaacattttaagtgtctagacctgagagccttgtgggtttaaaaacctgaatgggagaagtaagaaggagaaattaacagtttttcaatttttttcctggagagcagatcaaacagatgatggaggcagcaacacgacaaatcgaggagaggaa

SEQ ID NO: 346016 - DNA, 2434 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaccctgcctctgatcttcaatgcctttctcacttgtggatgtccttcctgtcacgacagagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346017 - DNA, 3102 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatcttacagaggaaaatcccaagagagaagattattttggaatcacaaatcttgttgaacatccagcccagctcaatcctccagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaagtgagaatttctaatttgatgcgagtattaggaacagaagctgttcaagaccccacgaaggtagaagcccacgtcagagctcagatggcaaaaagacagaaagcgcatgaagaggccaacgctgcccgaaaactcacagcagaacagagaaaggtcaagaaaattaaaaagcttaaagaagacatttcacagggggtacacatatctgtatatagagttcgaaatttgagcaacccagccaagaagttcaagattgaagccaatgctgggcaactgtacctgacaggggtggtggtactgcacaaggatgtcaacgtggtagtagtggaagggggccccaaggcccagaagaaatttaagcgtcttatgctgcatcggataaagtgggatgaacagacatctaacacaaagggagatgatgatgaggagtctgatgaggaagctgtgaagaaaaccaacaaatgtgtactagtctgggagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaacttggtgtgatatttttcacacattcgtaagtattagagtttgggtctacaggtgatcttttttccggacttttagcaattgctgtggaaaaaaacattttttgtcattgacatttatttatatatataaatggatgaatggatggatggatagatggatgtgtatttttgaagtctagtggaaatgtttgatctcatcctggagctagaatgataaatactgttttcctggagcagaatgaagcagggagatgtgtaaagtggtaagggaggaaggagggacaaatgagtatccatcccttaaccaagagaatcaccaggttagacagattacctcaggacttggctaagtagtctttccaggaaatcagttcctctaagggatgcatatgtgggaatgtgtgttgtgggtgaaatggacacagggaaagtccaaggaggatgctatgggtcagtttgtaaagtggaataggatttaagaatttagcccattttgtctcttttactagtttaaaaatccgcttctaatagaaattgtgtagtttttttttttttttttctatctatgaatccgactacatgtgggtggttttatttcagcatttaatgtttctggtttgattttaggagtatttgaagtccaaaatttttaccatacctatccttccgtttcatattgcctctgttgggaatggatcaaacaagtcaatagagctcccatacctt

SEQ ID NO: 346018 - DNA, 1183 bp, Homo sapiens
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccagatcaaacagatgatggaggcagcaacacgacaaatcgaggagaggaaaaaacagctgagcttcattagcccccctacacctcagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgaaggtggagttaaaagaccaaacgaaacctacaccaagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 346019 - DNA, 99 bp, Homo sapiens
ctctgggtaaagaaacacaaataccaaagcctgagctccttaaccttttgttccagagggcagacatttttaagaaaggtgaatgttagagaaggttac

SEQ ID NO: 346020 - DNA, 804 bp, Homo sapiens
ctgtctcatgcaccacatgattttgcacagctagaggatgacggtcttattaggaaatgaatggtgccctagagggatggatgctgggacatctgtctgtctgccatttattctcctagtctccctttcctctcctttgctcctgccatccttcctacgttctgggttgccttgctggtccttgttattgtctgaggatgaatagatatggggttattggggagggatatttacgtgggatcaacctgataatggcaatgccatttctgatttccagggccttttcgtcttcccttggcttcgcagacacacaccctgccggaagcgttcttaggaggcctggccgtgctttctcttgccctcagccccattccctagccctctaaccaggctgggcctgggtatctgtatccagggctgtgcctgaggggccccaccctgctttgggcatccatcacgctactgcggcccttactttcagtgctcttgtccaggtctctgtggtggcaggtatttatttttcagctcttctcttctccttctatttctccccaatctgctttcatctcacttcatctctttgtccctgtcctttgtgtctgtgtcagcctcggccttttcttgacactcctgtgtattttctgtcttccttcttatgtcttcatctgtctttgtctccatctgtcttcgttggtcttttctctgtctctctctttctctgtctttgtctctgtctctgtctctccctgcctccctgcctccctgtcctaacccaccacctcaaagttttttttagcttggaag

SEQ ID NO: 346021 - DNA, 578 bp, Homo sapiens
ctcgaacttcagctttaatagggtttcacaactgcatccctggatctcacatctctcttagaggcacttattttggagatgacgtcttgctacataaccaaggctggtctcaaaatcctggcctgaagcatttctctccaacagtaatgtaccatgtagctgtcattacagatgtgaaccataatgcctggttgtctcataaagtcatttttggtcagggatggctgactttttttgctataaggggatatgaaaatagagcacttttattattttcatcttactgatgtcactctccttataccttttttctttctatattctatttcaaatttgtaattttagattcagttatttaggataatatgctagaatttgcatggtatgctgaaagtaaattagataattagtaagcactccatatttatgaaaatagttactaaatataaacatagttactagttataagtagttataaaattatggaattttcatctactttcttcaccctgtatataaataatgagtttatttcctaatatttgttttacatatcagagggtctaaccctattctcc

SEQ ID NO: 346022 - DNA, 1144 bp, Homo sapiens
tgacatgctgagtgtacgtctcccatcacccaaatgcaagctccttgagagcagcgacgtggtatttccaatgcctggaaacagtacgtggcacctgatgagtacagtcaaaggtatttcggaatgtttgctgagtggtgactgatagcacagcaaagaagctccatgcagactggattgctggcatggggtaaggaggagaagccagccagagtgacctggcccagcgattgggaaccagggaccttgactaactttgtccagatgtaaagggctggaatgttggcgtgatggttgaagctgtaacagccatcttcgactacaaaatggaagctgcatgctacaaatgacagaagacaagatcaaaagaacctgtgttcccagcaccacagaactgtccctatggaaatagacatgactgttacataagaaagaaatataccctactatgtttaagcctctgttattttagcatgtgttgtagcagttgtatactaagtaactaatgagaaagaatattttgtgccctggtaaagatggatacttctatatgttatgagaacaatttgatgaggtaattgtaatttagtagaataatatcaaatattaatgtcaaatgactagtttggcattgccacatagtaattgttgggcaagttattaacctgtgtctcagtttcctcactggtagaataacaataacagacaatggtactagtgtctaacgttttactgaacatgtagcttggttcagcgccacacattatttgaattaagtagaataagagagtcctgagtaaatataacccaaatgtaaattatttttaaactttattacatatgtgaatattattatttgagcttctcatactgacttcttatttacttaactgattctaggcattgaccactcctgagattttgcatccatactccctaaaagttctggtccaaaatttagcacacaataaatatttaatgagggcatagcttatttttaagtaggtacctctattcacagaatgtttttctcttgattaaaaaaattaattgcattatatacataacataaaattcactattttaaccattttaagtgtacaattcagtggcattaaatacatttacattgctctgaaccatc

SEQ ID NO: 346023 - DNA, 736 bp, Homo sapiens
attggctgccattagccaataattataatagtaatgtgctgtgtagtaaaattgcttgattggcctcagctacccataaaaatcatatgaaatggttaactaactttatcaggttttttcaccttcaaaaaaaaacacctttactggccatatacagtgcagtacattttgcttactaagttatattccatcacaattcatttaagatatccatgcacagaaaagtaattttattatattctgttccttgttcaacatctaaatccatgtaccttttgtggtgggagcagcctgagaaaacaaagacaccatggactttgaacttagactaagatttgaatcttacttaaaagttctgtgaccttgggaaaattacctgctatctctgatccttagttcttcttccgtatgatgagtgtatgataatattacttaatattaaagatttcttctatgtgttgaagaaggtagagtgaagtagagaaaacataggtactgaacacatcttatttgtgtttccccctcctttcgtgttgtttttggattaaaaaaaagaaatctgactgggcgcggtggctcatgcccgtaatcccacaagtttgggaggctgaggtgggtggatcacctgaggtcaggagttcaagaccagcctggccaacatggtgaaaccctgtctctactaaaaatacaaacattagctgggcgtggtggcatgtgcctgtaatcccagctactc

SEQ ID NO: 346024 - DNA, 1017 bp, Homo sapiens
ggctgaggcgggagggtcacctgaggtgaggcgggagtgtcacctgaggtcaggagttcgagaccagcttggccaacatggtgaaaccctgtctctactaaaaatacaaaaaattagccaggtgtagtagcgggtgcctgtaatcccagctactcgggaggccaaggcgggagaattgcttgaacccgggaggtggaggttgcagtgagccaagatcgcgcctttgcactccagcctgggcaacaagagcgaaacttcatcttaaatgaataaataaataaagtagtttgtcatggcttgtcggcttttccctccaatgtaaaagaaactaaaagagaccttcttttgatcttgagattctgccatatatactgaggacaaaatatggtaaaaagagccgggtgcaatggcatggcctgtattcccagctacttgggttgtggtgtgaggatcacatgagcccaagagttcaaggctttagtaggctataatggtgcctgtgaataaccactgcatttcagccatggtgagacccccacccccaacgcttaaaatgttacgtgtgtgtgtgtgtgtgtgtgtgtgtgtgtgtctttgtgtgtatgaagaaaaaaatcttgcattgctggctaggatggggatgacagtagatttggttagatttaggaaggtattcctggtttcgagagttgtctatgtgtgtagtggaaccttcattttgttggatttggggacatatccttaaaatttggcaggattttcatctagatgtagttcaggcagttattttaagtggtgacttttggattagaagaacctatgtatcagccgggcgcagtggctcacgcctgtaatcctagcactttgggaggatgaggcaggcagattgcctgagctcaggagttagccaccaacttgggcaacacggagaaacaccgtctctactaaaaatacaaaaattagccaggtgtggtggtggacacctgtagtcccagctactcgggaggctgaggcagg

SEQ ID NO: 346025 - DNA, 410 bp, Homo sapiens
agataatggcttccagcttcatgcatgtccctgcaaaggacatgatcttgctcctttttatggcttcatcgtattccatggtgtatatgtaccacattttctttatccagtctatcattgatgggcatttgggttgattccatgtctttcgttaacagcatttaaaagcaagttgagccaggcgtggtggctcatgcctgtaatctcagcactttgggaggccgaagccggaggatcacgagatcaagaaattgagaccttcctggccaccatggtgaaatcccgtctctactaaaaatacaaaaattagcctggtgtggtagtgcgtgcctgtagtgccagctattcaggaggctgaggcaggagaatcacttgaacctgggaggaggaagttgcagtgaaccgagatc

SEQ ID NO: 346026 - DNA, 660 bp, Homo sapiens
ctacaggtatgtaccaccacgcccagctaatttttgtatttttggtagagatggggttttaccatgttggccagactagtctcgaactcctgaccttaggtgatgccctcgccttggccccccaaagtgctgggattacaggcatgagccaccgcatccagccaatgcaatggtatattatttggtcatataaaggaatggagttccagtacatgccacaacatgcatgagccttgaaaacatgatgctaagtgaaaaagtggtcactaaagactacatagtgtgtgagtccatttatctgaaatgtccagaacaggcaaatccatagagacaggaagtggatttgtggttgtcagggcctgggtgggagaagggaatggggagtggccactccatggtgctgggtttctttaggatgataaaaatgttctacaattgattgtggtgatatcggacaactctgtgactttattaaaacccaatgaattgcacattttaaaagggcgagtttgatggtatgtaaatcaataaaaatattgttgtagctttattgagatatacttaccatacaattcacccatttcatgtgtgcaattctgattttttttttcatttttatttatttttattttttgagacagggtttggctctgttgccca

SEQ ID NO: 346027 - DNA, 1046 bp, Homo sapiens
ggaaatgagacttttcagcacaaaggatcacccctcttacttttccagaatatttttcccgtaacagattattttgtctttgcttaatcaatgtttgtctacttcctttctggccatgtaaataattcatacagttcactaatgcaacttttaaaattattaataaaaatgtctgttttatatcacattctgctggcaaagcaaggggacggggctacttgaaaacaggaaacaggtagtataaaaatggccaagactaattctccattctcagagagcttataatcacttgcaagagagaatgcttgaaaagataaataggcagactatggttagtattatgagacagaaggggcctagatagatgaattgaagggatgaagaggcaagacattaattaggaatctattgatggtttagatgagaagcaataaggatcctaacagtgaaaataaagagggaacttaagccagaaataaaatgaaagtacatgaattatggcttcgttgctgattggctgtgaaggtcagaggagaagaagaaggagtcagtgctatctctaagtaggatttttgagtctgtaaacttgtaaaaatagtggtgtccttaaaacacacacagaaagaaagagaaagaacagattttggggagaaaagatgaacttgactttgaatttactaagctttagataaggaagtaaaacctagatgaaattgcccatcaggcaaaggaaaggtaaggttgaagttagaagtagatttagttgtcatctctgtagaagggattctcaccagacagagattttctaaagaagggactgaggcctgagggaatggctttacttaggaactacaagaagaaaaaaaaaaaaaatgaagaaatggtcattgacctatttgaagcttaggataatcctcaaacaatgagatttcactgtattttgtttttatttatttatttgagacagagtctcgctctgtcacccaggagaatcacttaaggccaggagtccagcctgggcaacatagcaggatcctatcccttta

SEQ ID NO: 346028 - DNA, 330 bp, Homo sapiens
tatttatttgagacagagtctcgctctgtcacccaggctggagtgcaatggcatgatctcgactcactgtaacctccacctccaggatgcaagcagttctcctgcctcagcctcccaggtagctgggattacaggtgcccaccaccacacctggctaattttatgtttttagtagagacgagttttcaccgtgttggccaggctggtctcgaactcctgacctcaagtgatccacctgccttggcctcccaaagtgctgagattacaggcatgagccaccgtgcctggctgtgtattttcttttgcttagccttatgttaaaagctccca

SEQ ID NO: 346029 - DNA, 298 bp, Homo sapiens
acaaaggggaccacgtaggaagtcactgtcctgctctgcatttgaaataagcactgttcagagccccgctgtccagtatggcagccactggccatgtgtggctgttgaatacttgaaatttggcccctctgagttgagatgtgctgcaggggtaagatgcataccagatttcaaagacctatcatggcaaaaagaatataaaatatctcattaataatgcttcagggtgggcactgtggcttatgcctgtaatcccacactttgggaggctgaagtgggcggacacctgaggtcagga

SEQ ID NO: 346030 - DNA, 840 bp, Homo sapiens
gaaaagtccttagctgatttggagtcccaccaccatggataacagaaacgcaatagtgaaccaatgcaaagttcactgtcaaatgccccaggtgtactgaggtgggataaaaagttttaagacaggctgggtgcagtggctcacacctgtaataccaacactttgggaagccgaggtgggtagataacttgaggtcaggagttttagaccagcctgggcaacatggtgaaaccctgcctctactacaaatacaaaaattagctgggcggggtggcgggcacctgtagtcccagctacctgggaggcttaggcaggagaatcgcttgaacccaggaggcggaggttgcagtgaaccaagagatggcgccagtgcactccaccctgggtgacagagagactctttctttttaaaaaaaaaaaaaaaaaaaaaaaatttaaaacagcctgaccagttagcttacgtccttgtcatttcttgggtggagggatagattttatgtctttgaatagtctacttgcaaaggggcatgagacagaaaaatcagttaaaaggctgtccttttcttggggttagcaaccatactgttttctgttacagcaagggtctagcccggtgcttgattacttactactcagttattaaatttattatgtgcagaatagcactggctagaatttgagcttagaaatagaaaggagcatgtttttgccttagggcctttgcatttgccaccttcaacctagaacgtttttctcctgtctcatttcatttgtcacctgagaacattgttattcacatatccattattcccttactcttaatttttttatgttgtcact

SEQ ID NO: 346031 - DNA, 1043 bp, Homo sapiens
cagaaggtaagcatgagcaaattactttttagaggtaactttgctgaacttgtgaagaatggtgtgcaaggtccagagcgactgcaggagagggaaggtgggattcccacagagcaggagcacagatgagccaagcaaggccctgcttggaaggcagcaatcaacagagatgcacagacctgtgagggtgccgggacagccatgcaacaatgcagcccttttgcttcctaagctcaccagttccctcgctccacctctgagaggtggtttggagaaacacagcccttctcaagagggctgcaagctacttaagtcctgaaaatttccacaaggctgagtcaaatctgcgtttcatcatctataagaaaggtacctatcgagaacaccctgctggccagtgtgtaaatatctaaaggaggactcagaaaacaccggggaagtccagcctgcacgtggtggctgggcttcagtgaagcatgcagcacaacaggagttagcagaccacaaagagcatgtctggacctagaaccacagcatgtaacctcggaagcagtgagacaccagccagcatggacaagcagcaggcacttgctctataccagatatgctgcatgatagaacgctatgccctctcacagataggtcccacctccagccttcccctgctgccatctaacatcctaaactccagctctgaatgtctgtctcctgctctgaatcttcagtgacttcgaaactcaagtcaggacacctctcagtttggcctcactgctcaagattgagctgaattcatgaccataattcaagcattcagattcatgggctgttttgtgggttttgctatctcttattttgtttttgcacatcttacccactgaaacgttgggctgcaaaaagtttgatcactaaatatgtaggcaatgctggatactgggctgttatttacatatttgtatcaccttttatttcataagatagcattgtcagagtaatttagtatttcaacataatcaacaagtaaaataaaattaatgagaatgatc

SEQ ID NO: 346032 - DNA, 746 bp, Homo sapiens
cagaaggtaagcatgagcaaattactttttagaggtaactttgctgaacttgtgaagaatggtgtgcaaggtccagagcgactgcaggagagggaaggtgggattcccacagagcaggagcacagatgagccaagcaaggccctgcttggaaggcagcaatcaacagagatgcacagacctgtgagggtgccgggacagccatgcaacaatgcagcccttttgcttcctaagctcaccagttccctcgctccacctctgagaggtggtttggagaaacacagcccttctcaagagggctgcaagctacttaagtcctgaaaatttccacaaggctgagtcaaatctgcgtttcatcatctataagaaaggtacctatcgagaacaccctgctggccagtgtgtaaatatctaaaggaggactcagaaaacaccggggaagtccagcctgcacgtggtggctgggcttcagtgaagcatgcagcacaacaggagttagcagaccacaaagagcatgtctggacctagaaccacagcatgtaacctcggaagcagtgagacaccagccagcatggacaagcagcaggcacttgctctataccaggtgagggtgtggagacatgacgtggtgcagggacaccagcacccagtcctagttctggtccctctcagccttgttaggtcctggttcctaagattccagggaacatccccacagcctcacaataagatcctcctttcctgcata

SEQ ID NO: 346033 - DNA, 2941 bp, Homo sapiens
ttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346034 - DNA, 2344 bp, Homo sapiens
  misc_feature (2216)..(2216): n is a, c, g, or t
ttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaanagcactgggggaccgaaagcgagaaatcccaaccgggggaggagagacagcaagagaatgcccgaacaaggaccaggtctctgcacgtaaaaacggcggcgaggccgaaggcataagcaggggaagcc

SEQ ID NO: 346035 - DNA, 2815 bp, Homo sapiens
ttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346036 - DNA, 1898 bp, Homo sapiens
ctgtctgcggtgactctgaggatccctgcatcaacgccgcgatggtataactgcagactgcacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346037 - DNA, 1584 bp, Homo sapiens
ccaaatgattgcatgagggcgtgcctgggttaattcagtgacgaggctgtcgtggaattagaagctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346038 - DNA, 600 bp, Homo sapiens
  misc_feature (33)..(34): n is a, c, g, or t
gcgttatagaggatcccgcacgaggggtgtccnngacatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346039 - DNA, 369 bp, Homo sapiens
tgtgtctaggtgtttgtgtccaggtgtgtgtgtccaggtgtgtgtgtctaggtgtgtctctttgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346040 - DNA, 284 bp, Homo sapiens
cgatactgggagtactggcaagttcgagtggggcagtaaacacagcaaagagaagtaagtgttgctgaccagctcagggctccgagagggaagggagtgggaagggagtcatgaggagggaaatacagggagaagccaggacacgctaagtggaccttggcaacacctccctagagattttagtgggacttgttgctggtctgttatgactacttggctcatgggtgagtgggtaggtggctccagggctccaagtccatccacggatgagggcacacagggca

SEQ ID NO: 346041 - DNA, 285 bp, Homo sapiens
cctggcgcacgcggagcctcctggagcctgccaccatcctgcctactacgtgctgccctgcgcccgcagccatgtgccgcaccctggccgccttccccaccacctgcctggagaggtaaggggaggttgtccaactgcttgggggaagtcccaccaactcttagggagtggagcggcaggcctggggacctgggtgggcgcggggatggggcgctagaggcttgagtagagaggtagaagcgcacttgatgccacgtgctcagattccaggagcagggagaaagc

SEQ ID NO: 346042 - DNA, 3164 bp, Homo sapiens
ttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatgaaaaaaaaaaccacaaacaaaaacaaacaacaaaaccaaaccaaccacactacctctaaaaactctcccatcccaaaaaacccactaaaaaaaaaaaaaatttgtggcccttctggcccaatgcgcttttgaccttgggcaagctttatcatggggcccaaatttgggcctctttggccaattcgcccttaggggggccgtttttccaggggcggggttttcac

SEQ ID NO: 346043 - DNA, 2388 bp, Homo sapiens
agcagttctgctgcaaagaagtcttctgcacccaggcgcacttctgcacccaggcgcacttctgcacccaggcgcacttctgcacccaggcgcacttctgcacccaggcgcacttctgcacccaggcgcacttctccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346044 - DNA, 2162 bp, Homo sapiens
gcagggttgctgtagaagaaagggtgaaaggggattgcgtttgtatacattcttgatagatcctcatgttaattctgagagattggaggacagacactggatcagatgtgggtacaagcccagagctgaaaagctagtgatcaactcaggagcccccacttcctgatgcagcatccgatgctctttccaatgcccagcctgccgttggccctccctcagccatgcccaccctcttccccaactcaccctgtgtgtgtcctccttcccgcaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 346045 - DNA, 1205 bp, Homo sapiens
ttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccgcgagctgacgaggatgaacctgcagactgccacagccacatgctttgatgcggctcaggggaagacacgtaccctgatggagaaggactcctacccacgcagccaggtcccggtaagcaggcgacgtcgacc

SEQ ID NO: 346046 - DNA, 109 bp, Homo sapiens
aaaagtggattcttattctagaataacaaaacaattagaaattggcattttttaccaacccattatatcaaatattactctcaatactattctctgctttccaacaacc

SEQ ID NO: 346047 - DNA, 1273 bp, Homo sapiens
gccaagattccctcagtccagtacctccttgctcctttccagtcttctgtcctgggaggctgagatttatgggtcttccttgccctccactaccaatttctatttccttgactatgcccctctctacaaggtctttttggtttcactgcctacatagctttaggtatactacctttccgcattgttggagcatgaggcagttgggccaaaatggcattaaagcctaaagtgaggcatgttcaagatgccacagtgaccaaattcacgccatccaggatgcacctgactctggaagctgatgaggctaatgatgctaacgtgtatcctggatccctgaggtccgctcccaacatcagcccttcagcctcagctgggttctaacaaaaccccctgccacctccacgttgatctttgttgtcattctcatcgcagtgctttggtatgggaggtgttagaaaacttagagactagaattgtggaggttgggaccttgtaactccaataagcactgaagaaggtgtctctacagtcccttcttccatggagctggaacccccgcacccaccccaagtgtaaaccctctcctcctgcaggttcaagctcctcagtcccagggaactaaaactgaataatgtgaggaagcagtgatgtttctgctcaaactgtgatctggatccagaaactagccctaaacagctcatggcttctcaggaagctttataaaaggactgtctcactcacattctgcctactttcccatcttccctcctgggaaaatgaagtccagttaatggaatcagcacctttccttcattcctggtagattaacccttggcattaagcagatagatatttctaagattattctaccagattcatgaaggctaaagggaattccttttgattttgtccttgttacttaggggtcagggataaggatggtagagttgattgaggccctagatcaggaccattgtcagaaaatgaatggcatggccgggcgcggtggctcacaccttaatcccagcactttgggaggctgaggaaggcaaatcacaaggtcaggagttcgagaccagcctggccagcatggtgaaactctgtctctactaaaaataaaaaaattagctgggcatggtggcaggtacgtgtagtccctgctactcaggaggctgaggcaggagaatggcttgaacccagcagatggaggttgcagtgagccaagatcgtgccattgcactccagcctgggtgacagagcgagactctgtctc

SEQ ID NO: 346048 - DNA, 460 bp, Homo sapiens
ctagaaatgaactgagctggagtttgaaccagacagtttggttccaatccttacttcttaagcacttcaccatagtgcagaaggataagacaggcacagtgcaatgtacatgttggtgctgttgttattaataaatacagttagagcaatgactgttttgtgggctcagagaggctgctgtcctatttcttgctgaagcagtgggttgaccaaaggctactctgtttttggtggctcaaatctttggtggcacataagctgctgtctcctattgaagttaaaattcacaagtgccattgaagagcttttcagctgaagcacatagcatttatccaaactagagaccttgaaagccggtgattagggtggattgtgtacacattcattccaagtttagacaaaaaaaaaatggggagaaggagggaggaggttggagattttcagagcggttgcttagaaa

SEQ ID NO: 346049 - DNA, 126 bp, Homo sapiens
ttttttttttcataggcatgatgtatcattcttggcttgtcttaaagagttatgcaaattgtctaaactttcagcagtgatatgtcactgaacttataggcatttagtaataattcaaatagttaa

SEQ ID NO: 346050 - DNA, 727 bp, Homo sapiens
agttttcaagatgtattccctctctgacatctattaactagcacagagtcttcaggatattattaggtgctcaataaaagtttattgtatgagaataagcaatattttctttatctctcatttggttgtatctttccctactttgttatttcattttttcttacattttatctttgtattctgacactatttcttagttttgcttctgttttccccagaagagtactttggttaaaatgtatcacttgcaaaatagaataacacaccgccatgtagtgttgcttcaggttataattttccatatatgtacagtatgccaaaaggatgctgcttctagagagaatgtttaaaactcacttctctagatttttttaaagttactttagtgtttcacatgtttgccagatatcattgtcattgaagataagcattgattaaatttcagaattttattaatgaaagcaatcttttgagcaaatttagaaaataaatttagttttggtagggtatattatttattttttgtagcaaaattatttcttcataatgtcaaagataatagtcagtgttttacattatcaaagtaaattcccaaaggtaaagaatgatttgtgagtgccactgggcttggctgtgctgaaattgtgagcctgttgttacttctgatttatgactgggaaagtctgtgttcattgtgctcactctgatgtcctagtcaggaaaccaa

SEQ ID NO: 346051 - DNA, 507 bp, Homo sapiens
cagaaccacacaaaaccccttgatgccagcaaaaatctctttctggatagagattcaggtaattgttttagaaggcttgattgacttattgtacaaaattaaatttttggtgaacaaaatatcttggcttagaattttaaaacagtctgaacagacgatgacgttaagctgttgtggctacagctttgtgccttttagggttacacgattcaggagatgataaaattgcctcccaactaatattgtccatgcggaggcttcgcagatcagcgattttcaccctaaggctcgcatgggcttgtggtcaccgcatctctcttcatctcgcagccttcgcaagacgggagggaggctgcgagatgagtctgtgggatgcaaaggagccacggccaccccacatcttccgcagataacacgttcacacctgcgccccttctatttaaaagaaacaaaatctctcactacatctcactttttagagatagcctttgatgatattactgccag

SEQ ID NO: 346052 - DNA, 142 bp, Homo sapiens
ttgggattagacactgaccttatacctttcacaaaaatgaactcaatatggatcatagatgacatcttgattgcttccaattttttggcaattttgaataaatctaatgtaaatatttgtgtgcaggtgtgtgagtgggcat

SEQ ID NO: 346053 - DNA, 771 bp, Homo sapiens
tgcatttgaggacctcgaggttagaggatcctgtggtctgttcctatttatgcagctcgtggtggaacttgtgttccaacccaggtcttctgtctctgactccggcgcgttctctgccacacccagctcttggggtcgtattgactaaggtgggtccgtaactgtcactgcagtgggcactcaggggaaccctggaaagccacagagaaaatccactagcacaactgcaccttggggaaagcgcttcgtgtgtttgcttcagctattcaaggagtcctgagctcctgtacgatgaaaatgtttcttcatctctgacacttctgtggggcttcgcatacaatgctgagttacatcgcgagttatcaacaaacatttctggaatgaatgatccactgagttgggagagaaaagccaaggggggattttaacacagggggctttctaactgggcctagaaactggtgactccatgcccctaggaataaaacaaaataggagagaactgaaatacaaggttacacatcaacaagaattccacattttaaaaagagagagagagatgaaagatctacaggggctgtgtgtcagaccctgatgtctcacctctcggaagggccttcctggacttcaggccccaactgtcctagcaattccaagaaaagaactggggaatgaggaccatccatccaggaagcatgtttctggttccaggtggtcggtcactaggcgttcctcctctgcccttagaaacatgccaggggccgtatttct

SEQ ID NO: 346054 - DNA, 716 bp, Homo sapiens
tgcatttgaggacctcgaggttagaggatcctgtggtctgttcctatttatgcagctcgtggtggaacttgtgttccaacccaggtcttctgtctctgactccggcgcgttctctgccacacccagctcttggggtcgtattgactaaggtgggtccgtaactgtcactgcagtgggcactcaggggaaccctggaaagccacagagaaaatccactagcacaactgcaccttggggaaagcgcttcgtgtgtttgcttcagctattcaaggagtcctgagctcctgtacgatgaaaatgtttcttcatctctgacacttctgtggggcttcgcatacaatgctgagttacatcgcgagttatcaacaaacatttctggaatgaatgatccactgagttgggagagaaaagccaaggggggattttaacacagggggctttctaactgggcctagaaactggtgactccatgcccctaggaatattttaaaaagagagagagagatgaaagatctacaggggctgtgtgtcagaccctgatgtctcacctctcggaagggccttcctggacttcaggccccaactgtcctagcaattccaagaaaagaactggggaatgaggaccatccatccaggaagcatgtttctggttccaggtggtcggtcactaggcgttcctcctctgcccttagaaacatgccaggggccgtatttct

SEQ ID NO: 346055 - DNA, 245 bp, Homo sapiens
tgaaagcaccagatttccgcgtaggagggactcgggggcaacgatgcaattggaaggtaagggttccaggaacaaagtcactcactgtcctgtgggtagtctccgagtctctgcgaggacccactgcacggcaggagctagtctcagactgagatgcctaccgggtacctgccaggtgggccaggccctgttctcaccactgctctgaatggtcaccacagagaatggtctccctcctctcaggg

SEQ ID NO: 346056 - DNA, 896 bp, Homo sapiens
tgaaagcaccagatttccgcgtaggagggactcgggggcaacgatgcaattggaaggtaagggttccaggaacaaagtcactcactgtcctgtgggtagtctccgagtctctgcgaggacccactgcacggcaggagctagtctcagactgaggtgagttctcggcagcagaaggcaccaccgcactcccaagggctaaaggtttaccctgcacctctcctactgaagcttgcagagggttggcatggcagccttcttcatcataggagactctaagactgctacttttggctcctctgggttgtgcagcttgagtggaagagcagatcctctcacagcctagacctcctggccagccgtttcttgccctagactccactccgagtggcagtctcccaagctgtctaataggcgtatgggagaagtatcagcaagtatgctacttctaatgtcccaggtggtgcacccagcactgtgcctcttccctagtgcagctgaaggaaagctgccactgcctgtgccttcctttacaagggttgtcctggcatgtgtcagaccactgggtcccctaacaaccttgccaatgtgccagtcctctgaatgtttctggctttagcccctgcccttggcttgcacgtgtcttcttcctaggacatccggggtgcttgtgtcatatgctggtagcataatgtcatcaacagtgcaccagtgtgctgtgcaaactatcccgagacagcctgtatgcatgcaaaatatgctcaaaagtacccaaggccgaggcgtggcagctcatgcctataattccagcactttgggaggctgagactggtggatcacttaagcctaggagtttgagactagcctgagcaaaatagtgagaccctatctcaactgaa

SEQ ID NO: 346057 - DNA, 294 bp, Homo sapiens
ccagtctcaggtagtacctttacagcagtgtgagcacagattaatacataagagttccttatattttacatgttaagcttttatcagatgtatggttttaaaatatttttcccatccataagttgtgaataatacattaaagccttacaataaaaaccaaatatttcttccactgtatatataaacagaaaacatgaatactttcagaatatttactcattataaaaatatgccaaattagtattattagcagtattatctatttgtatgtaacaactccagcagttaaaaatt

SEQ ID NO: 346058 - DNA, 225 bp, Homo sapiens
tactctttagtcacattctctcacccatcctgcaactgttgtgcatgttgagaaatgcagtgcatgataaagaaacatttaaattaaatctttagtcctaatctgaaaaaaatcaatgtttaaggatatttgttaagacattgctatagaatgttctgggcctttggcctcaggttgtggtgatggatgtgtatgtagtagtacttgaagctttctatggctata

SEQ ID NO: 346059 - DNA, 526 bp, Homo sapiens
ccggccgagaattcaatcttccttgttagccttggagaattcatttgatttattaaaggaagatgttgttttcttcttcacaactttttggagggtgtccttggcctctgtactctacaaagttcagtcagagagggtgcaagccagggtaggagtgtcagtcccagtggggtttgctaatgtgcagatacagcaggtgctacagggaagggaaagggcactggggtgagtcaggtctaggttctgccaccggcttcctgggttcctttagacaagtcacttctctctgagtctcagtttccccatatgtacaatggagttggggcagatggcctccaagtcccttcactctaggaggcaggaacacccaggtgcctccagggttggggcttcttcagtgggggcgctcagtctcccacatgtccagacccccactcttgggggattctggagccggaagggtcctgggcatcccgtttgatctgagcacagtcccccagccacaggcttaagccatctggagaat

SEQ ID NO: 346060 - DNA, 686 bp, Homo sapiens
ttggaagtattgttgtagaactggcaaaaattaaaggagaagaaagaacaacaaaagcattttggaatggataacgaaaaacaggggtaacggtagaagttatacttagtgttagtaaatatagttaataaatatacagtagggccatgtgcgagtgactgtttccatgtcagcatattaagtttgttgacttaataatgctgtgtattatatctgtttctcatttggaaagttgctcaaatttgcacatgagcatagattgaagttagtgtgtccaccctttgaatcatattgttcctgaaaaaggtacaccctgttttaaaagtttactagtgttgttttacttttatttctatcaaaggaggattaaacttatccatggtatttaaaaatagatgtgtctgctgggcgcagtggctcacacctgtaatctcagcactttgggaggccgaggcgagtggatcacctgaggtcaggagttcaagaccagcctggccaacatggcaaaaccccgtctctactaaaaatacaaaaattggccggcacactgtcacatgcctgtaattctagctactcgggaggctgaggcaggagaatcgctttgaacccgggaggcagaggttgcagtcagtggagatagccaccactacactccagcctgggcaacagagtgagactgtaaaaaa

SEQ ID NO: 346061 - DNA, 286 bp, Homo sapiens
gccagcagtgtgccacgtgtccccatcctctgactgcagggagagtacagacccaaggctgtagctgggtcacgagctgcatgggcaggaatgcagggtgagctaactgggattcacgtgttttcagccttgcttacgtttatatgatgtatattttcaaatttcgtggactttctgcataaggttttagcagctataactgttttgtttttttgttttttgttttttgttttgagatggagtctcactctgtcgcccaggctggagtgcagtggcacgatctcag

SEQ ID NO: 346062 - DNA, 612 bp, Homo sapiens
tgtgctgtgttcgtgtaggcataatgtgaggaggtggggagacaccccacccccatgtccaccatgaccctcttcccacgctggcctggcatgtgctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgctggcctacagcacatgccggtaccgagctgattgtatt

SEQ ID NO: 346063 - DNA, 549 bp, Homo sapiens
gctatacaactcgagctcggtaccggcatgtgctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgctggcctacagcacatgccggtaccgagctgattgtatt

SEQ ID NO: 346064 - DNA, 637 bp, Homo sapiens
  misc_feature (510)..(510): n is a, c, g, or t
  misc_feature (526)..(526): n is a, c, g, or t
  misc_feature (541)..(542): n is a, c, g, or t
tgtgctgtgttcgtgtaggcataatgtgaggaggtggggagacaccccacccccatgtccaccatgaccctcttcccacgctggcctggcatgtgctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttagtggaggacaatatattataacaggagatagtcaatgtacacatgactggggaacttggccgctcggtacccggcatgtgctttttgtcttgctgtaatagcacgnacagtgaagcataagngaatatggtctgttnntttaactgctcaattttatacatcatgatctgatcggtcgcttcatcgctggcctacaacacctgccggcaccggctcggcttgtactatgtctg

SEQ ID NO: 346065 - DNA, 821 bp, Homo sapiens
tgtgctgtgttcgtgtaggcataatgtgaggaggtggggagacaccccacccccatgtccaccatgaccctcttcccacgctggcctggcatgtgctgtaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatccgaagtgctgggattacaggcgtgagccagctcacccggccttaggttggggcttttaaatgacccttcaggtgtgtgtctgtgatgacttgaggcttttttttttactgtcttccagtgaaattaccagatgaatatcagtggtgagaaatttgattccttgaaatgtaaggaatttcattcttgaattgtgtgacaaaaccagggagcatgattttgggtccattcaggatctatccagtcaacactgagtatatagttgttgatggagactatgataggttctgaggatggatctgttatattctccataaatctgtatgtgagtcatgcctttgtttgcttcctacttgttctgtttactgggttttttttttctttgag

SEQ ID NO: 346066 - DNA, 414 bp, Homo sapiens
aggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgctggcctataagaagtttgatgccacatg

SEQ ID NO: 346067 - DNA, 1730 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346068 - DNA, 1702 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346069 - DNA, 1614 bp, Homo sapiens
gcataagcctgcgtcagattaaaacactgaactgacaattaacagcccaatatctacaatcaaccaacaagtcattattaccctcactgtcaacccaacacaggcatgctcataaggaaaggttaaaaaaaaagtaaaaggaactcggcaaatcttaccccgcctgtttaccaaaaacatcacctctagcatcaccagtattagaggcaccgcctgcccagtgacacatgtttaacggccgcgagattttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346070 - DNA, 1292 bp, Homo sapiens
tttttttgaagagaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346071 - DNA, 1305 bp, Homo sapiens
cgggtccaggtcgtctccacccttgaggttttcatggttgaggtcagtcttgtgcttgtcagtgggtttgtagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346072 - DNA, 1632 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgattacgataaatagcagttgggcgggcttgtccaaagatagaatcttagttaaaaaaaaaaa

SEQ ID NO: 346073 - DNA, 919 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagtgcctaagacagaaattcgggaaaaactagcccaaatgtcagacacacggatgtccatcttgtgttggattcgaactctttggtggtgcagacactgctttgctgattatgatcccggtgtgcaagaaaatgaccattgatgcagacgggcgttgagagaaagacccagaagagaaggagcgacgatggagcggggcgcagcccttggcgccacaaatagttccggggatgtacccaggaaggggagatggcgggtgtggaaacctcaaaaaaaaggggcggaaggggggagagagggtaccgcgggtgcgcccag

SEQ ID NO: 346074 - DNA, 770 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagcaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346075 - DNA, 1112 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacatgtattttataagaaaatgttaagtcaaattttagtggctctttaattcctgacctcttcattctccttttcagtataacctcccctatgctcatgcccacacagacaaaaaaaacaaaacgaaatacacacagaaaaaagtctttccaaactgtttaacgtatttaaaccatctgagccaaaagcagcatagcaacgtcatcgctcatccactggctcacatcacctttgccaacataggggctatcagaattacctatatctggccatcgcctggattcatacaacctctcatatcctgctccatacttacaccggtggttcgcacgctttcaccacatctgcgcgcctggctccactggactccacgcacagtttcgcatccctccggagcacacaccgctcctcatgccgcctcctaaacgctaacctggccttggctaacaaagggcatgtacatagtcaccttactacgcgcaggaccccgtttcaacatttccccacacaggccactattatttccaaccacacatttcccggctgaactactctaccgcttcggtgaaacctacctagggcgcatgcacaccagtaacaggtgtacatctaccgaacatttacggaaaatggttaaattgccctacttacgagcactctcgcactagcgaaatacaccgtggtactaaccgctaaggcaaggcttgcacgaaacccacaccctgaaggttaccagctggtaaggaccctcctcaattctcctaaaatacctttgccttagctattcgagccttcccacttcctgaaggtcaccacttaagggctccgccaactggtgaacattataattggcaagctgctagtcgatacagcaccaccacttgtgaaccaggcaacttttaaaatctagatagtacgagctaccctaaacacactaaccctttgccaaaaatcctcgtagtggcacaccacacggctgtacgcccaaaagagcagatatatggtaaaaca

SEQ ID NO: 346076 - DNA, 912 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaaccatcgaatacgccgcaggccccttcgccctattcttcatagccgaatacacaaacattattataataaacaccctcaccatacaatcttcctaggaacaacatatgacgcactctcccctgaaactctacacaacatatttggtcaccaagaacctacttctaacctcccctgtccttattgaattccggaacaggattaccccccgattgccgctaccggaacaatcatacacctccctatcgaaaaaattcctaaccattcagcgctaagcttacttattatggatttggctccataccctttaacatcttccagattcccccctcaacaaagcacaaaaaaagcaaaacaattctggggggcccccccccggaagttacaccattggtggggcggggacagattgaaatggccgggccaggaccgcgtcgcgggggcccacaaacgcgggccgctacacaaggcggcagtccgggcgcaaacccg

SEQ ID NO: 346077 - DNA, 199 bp, Homo sapiens
ggggcctggacagatggcaggaacagattttggggagccgtcacaagtgtgggtttagacacagggttcaggtgcctttaggacatccagggggccaaggcccaggcccgttaggagcagcagcaggggaaaccctgggcctccacaccctggttgaggtgggacaggctgctgaccactccctcgtgtgtccccatag

SEQ ID NO: 346078 - DNA, 1351 bp, Homo sapiens
cttgaatggtccaaaaatgaaactgtaattgaaaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346079 - DNA, 872 bp, Homo sapiens
attaggcgcgttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttaaaaaaaaaaacaaataacaaaaaaaaacaaaactttgggcggggggctgggcccgggaaaaagtttttctaagaaacttgtgtgggggggggggcccaggtgtgtatgggaacaggggcgccaagggggccagag

SEQ ID NO: 346080 - DNA, 858 bp, Homo sapiens
  misc_feature (20)..(20): n is a, c, g, or t
gcagtggtatcaacgcaggnctggccattatggccgggggggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccccaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggccggatggccgagccggggtctggccatgacaccagagctccggggggtgacaagaggacccccggcactcccagggaagggcacacgaagcgtcagcgccggagggaaatgggtaaaaggacc

SEQ ID NO: 346081 - DNA, 205 bp, Homo sapiens
atcttcaatcttcccctcctgccctgcccatcaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttc

SEQ ID NO: 346082 - DNA, 298 bp, Homo sapiens
tcatcttcctgtctcagcctcccaaatagctaggactataggtgcatggcactgcactgcacctggctaattttgtttttttgtagaaatggggtcttgctttgttgctcaggttggtcttgaactcctggcctcaagtgattcttccacttcagcctcccgaggtgttgggattacaggcatgagccaccgcccccagacctaaatcaattactaataaagatttattctttaaaggcagagaaagagacattgctgtcataccgaaacatgattttgaacttactgaattttgaag

SEQ ID NO: 346083 - DNA, 640 bp, Homo sapiens
cattctaggatgaagtgtgtgtgtgtgtgtgtgtgtgtgcacgcgtgtgtgtgtgtgtgtgtgagagagagagagattagagaagtctagagaagtcctgtccaggcctccctcccttgtaggaaggggtggattccctgcttttggatgctctgctgtcagagaagatatcttaaagctgatggccggccgggcgcagtggcttacgcctgtaatcccagcactttgggaggccgaggcgggcagatcatgaggtcaggagatcgagaccagcctggctaacacagtgaaaccccgtctctactaaaaatacaaaaaattagccaggcatggtggcgggcgcctgtagtgccagctactcgggagactgaggcaggagaatggcgtgaacctgggaggcagagcttgcagtgagccgagatcgggcaacagagcgagactccgtctcaaaaaaaaaaaaaaaaaaaaaaaagttgatggccatgatgcaaagtactgaggtggtatgcttgtctttaccattacaggccaagaccaatgaatggatagcttctgaggcagaatgtgaattatgtagcttttctactcagggaggaccaatgaggtgatgctgtgagccccaaagtagagattgctggta

SEQ ID NO: 346084 - DNA, 422 bp, Homo sapiens
tgagacagtctcactctgtcgcccaggctggattcagtgatggtagaagacagaggaactaagagggctttaaggctactttttccactgcaaacaaaagcttcaggaagtgtctcctaacacatctacttatgcccttagcatctagtcctctgcctgccacttagtaagtgaacagcaagtatttgttgaatgaataaaaagcaagaagttgggaaccaaatgaatgcttgtctcggccgggcgtggtgtttttgactcttgaccaccgtcttaacctataattggtacccagcatatctcctcataatagagtagcttccatcctgagatctctccctttcttctttattcatacaagtatcgattttttttttccattcaattttttttttttccattttggtttggaaccttttttt

SEQ ID NO: 346085 - DNA, 225 bp, Homo sapiens
caagtgatccagccgcctcagcctcccaaggcacatgagccaccgtgcctggcgtttttgactcttgaccaccgtcttaacctataattggtacccagcatatctcctcataatagagtagcttccatcctgagatctctccctttcttctttattcatacaagtatcgattttttttttccattcaattttttttttttccattttggtttggaaccttttttt

SEQ ID NO: 346086 - DNA, 1068 bp, Homo sapiens
gcactttttaatcactattttattgacatcctccctgccccgcttccaatgcacaacactgcattgagccccctgaggtgaaggacatgtattctatttctctgttacttccccctaccaatagaaaatatgcacagtcagtactaagtaattcctggttgattgacttgaaacttaataggggaaacaggacagtaaatacaacatgagagcgcacaaacactgtaaacatcctgagggtttggggaactactgtggtggataaacacaagagtaattagccaaagaatgttcagttaagaaataatttgaaaaataggtaagacatagtttgacagaaacattcccaaagtgagaaatgacagccaggagcaggaacagagctggtgggtggagaggacaaaaagcttgtgtacctaggtgggtatgcaaaaggccaagcccgtcaccaaggatattaggtgaagagagcagtagctgaaatgtcttgagaacaatgattatgagcttaactgagacaatggcaacaactgtgtgtttctacaaatgggaataaacgtaagactgtgtaagacactgtctgtgaactgtacatattggacaggaaacggggtgagatgaccagagccaataccagcatctggaaaagagagataagtattagaaaagggggcaggattcagtgatggtagaagacagaggaactaagagggctttaaggctactttttccactgcaaacaaaagcttcaggaagtgtctcctaacacatctacttatgcccttagcatctagtcctctgcctgccacttagtaagtgaacagcaagtatttgttgaatgaataaaaagcaagaagttgggaaccaaatgaatgcttgtctcggccgggcgtggtgtttttgactcttgaccaccgtcttaacctataattggtacccagcatatctcctcataatagagtagcttccatcctgagatctctccctttcttctttattcatacaagtatcgattttttttttccattcaattttttttttttccattttggtttggaaccttttttt

SEQ ID NO: 346087 - DNA, 1014 bp, Homo sapiens
gcactttttaatcactattttattgacatcctccctgccccgcttccaatgcacaacactgcattgagccccctgaggtgaaggacatgtattctatttctctgttacttccccctaccaatagaaaatatgcacagtcagtactaagtaattcctggttgattgacttgaaacttaataggggaaacaggacagtaaatacaacatgagagcgcacaaacactgtaaacatcctgagggtttggggaactactgtggtggataaacacaagagtaattagccaaagaatgttcagttaagaaataatttgaaaaataggtaagacatagtttgacagaaacattcccaaagtgagaaatgacagccaggagcaggaacagagctggtgggtggagaggacaaaaagcttgtgtacctaggtgggtatgcaaaaggccaagcccgtcaccaaggatattaggtgaagagagcagtagctgaaatgtcttgagaacaatgattatgagcttaactgagacaatggcaacaactgtgtgtttctacaaatgggaataaacgtaagactgtgtaagacactgtctgtgaactgtacatattggacaggaaacggggtgagatgaccagagccaataccagcatctggaaaagagagataagtattagaaaagggggcatccactgcaaacaaaagcttcaggaagtgtctcctaacacatctacttatgcccttagcatctagtcctctgcctgccacttagtaagtgaacagcaagtatttgttgaatgaataaaaagcaagaagttgggaaccaaatgaatgcttgtctcggccgggcgtggtgtttttgactcttgaccaccgtcttaacctataattggtacccagcatatctcctcataatagagtagcttccatcctgagatctctccctttcttctttattcatacaagtatcgattttttttttccattcaattttttttttttccattttggtttggaaccttttttt

SEQ ID NO: 346088 - DNA, 763 bp, Homo sapiens
gtaaagacctgttaagccaatggcaagacactagatcctctggcttccaatagcgaaagagttcgtgcaagaagtgcctggggtgactcaagagtcatgtaacttcttttctggaaacttccttttcttagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgatcactttcaaa

SEQ ID NO: 346089 - DNA, 426 bp, Homo sapiens
taaatttttgtattttatttatttatttatttttaatttttgtttttgagatggagtcttggtctgtcattcaagctggagttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgatcactttcaaa

SEQ ID NO: 346090 - DNA, 491 bp, Homo sapiens
tgatttgctcctccttgaccagggtgggaagtaaaagtgtgtgtgtgtatctgtgtctgtatgtgtctgtgtgcatatgtgtgtgtcggcgactcgtggaaatgtccacgtggacatttccacgagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatggttctcctgtgatgcacgcttgatcttgttgcatcacgccctcgc

SEQ ID NO: 346091 - DNA, 436 bp, Homo sapiens
ttcccctggcctcatagtgatttcttttaagatgagagtctcttctctgcatggggacttatgccaacctcagccagctgtacttggtgcctctgagtacagttttgctccaggagagaatgttcagtgtccccaggaaaagacagagaaaaatattttcctctccttgaaaattagcgtgctatctctccctcttgtgttgcctcttcctactatagttcacacccaacctcttcctgaagcagatgctagagaggtaccaaaacaacagccctccaaacaatgatgaccagtggaaaaacaatggagtcaccaaaacctgggacaggctcatgctccaggtaagacctgtggtcttggggagatgccatttttacttactggtgggagtgggtgtcatacacatgactcagtgggaccctatattttatttcaa

SEQ ID NO: 346092 - DNA, 2038 bp, Homo sapiens
  misc_feature (3)..(3): n is a, c, g, or t
ggnacgggccctaccgtgtgcgcagaaagaggaggcgcttgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacgagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttcctttaggatctcaggcttctgcagttctcatgactcctacttttcatcctagtctagcattctgcaacatttatatagactgttgaaaggagaatttgaaaaatgcataataactacttccatccctgcttatttttaatttgggaaaataaatacattcgaaggaacctgtgttatcacagtaacccagagctgtatttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgatcactttcaaa

SEQ ID NO: 346093 - DNA, 2150 bp, Homo sapiens
  misc_feature (3)..(3): n is a, c, g, or t
ggnacgggccctaccgtgtgcgcagaaagaggaggcgctggacttatcctaccttaagttgaagcagaccagcaattgttgtgacctacaatctccacacccatctttactctgagccaaggaagtgtctgttcttgtgctgagtttcaggtgccttcagcttgtgggaaatcccgaagatggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacgagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactttttgggttctcctgggtaccatgttctactggagcagaattgaatattaagcataaagtgttgccaccatacctccttccccgagtgactctggatttggtgctggaaccagctctctcctaatattccacgtttgtgccccacactaacgtgtgtgtcttacattgccaagtcagatggtacggacttcctttaggatctcaggcttctgcagttctcatgactcctacttttcatcctagtctagcattctgcaacatttatatagactgttgaaaggagaatttgaaaaatgcataataactacttccatccctgcttatttttaatttgggaaaataaatacattcgaaggaacctgtgttatcacagtaacccagagctgtatttggctagcaatctgcctgtatctctcactattatctaaaagaaaccttccaatgcttctgttgatctcagtattgtcaggggaacagagaagttgggaaaagattactgaaatataccttttgcatttctttctagagtagctcccatatatggagatgggtgattctcttgatgccaccttcagatccttttattctccagaataattcttaacagtggttcaaatttcctttcataccttgaagtatgtgtttagtagcctcaattctccattaattaaaagtgtgggctgggcgtgggggctcatgcctgtaatcccagcactttgggaggccgaggtgggcagatcacctgaggtcaggagttcaagaccagcctggccaacatggtgaaaccccgtctctacaaaaatacaaaaattagccaggcgtgatggcaggtgcctgtaatcctagctacttggcaggctaacgcaggagaatcacttgaccgggagacagaggttgcagtgagctgagatcgtacctattgcactccatcctggatgaaagagccagactctgtctcaaaacaaacaaaaaagcgtggggacttctggggacagacaaggtgcctgttatatatttactcagtctttgccctgaatggtctcagcttgagaccatttcaaactggagagaagcaagccagccaatagaatggggtgatttacagggatttctgtttactgtcaaaatatttctcatctgcactatgtttccatttgtggtcctgaaggaaattcttataactcaacatttgtctggtcttataagtaaagacagctttaaaatctgatcactttcaaa

SEQ ID NO: 346094 - DNA, 1532 bp, Homo sapiens
aattccacttaacgctggaagcacgcagacgctcttgaggcgggcagctgcgtagcgtgtggaggagccgggagagcgcaccccaatgtggcacctgagcgtctgggaccgaaccagcatggggagtcggaaggggacaaatccgcgatcccagtcatgcatctctgctttcccagcacgctgcctcaccaagaaagaatccagagaaggactggtggacttggaatgttaagtcatggcccatttgatgatgttcagggatgtggctgtagatttctctcaggaggagtgggagtgcctggacctggaacagagggatttatatagagatgtgatgttggagaactacagcaacatggtctcactgggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttactt

SEQ ID NO: 346095 - DNA, 386 bp, Homo sapiens
gggccaggatttcttcaggttccttctgacttacctccaaggaagaaaatggcatttcctatttgtccctttgagagctctgagaaaggcctgaccttgtgattctttccttctagctctgctttcccagcacgctgcctcaccaagaaagaatccagagaaggactggtggacttggaatgttaagtcatggcccatgtgagttggaattgcctctctccaaaaatataacccatttatatcaaatcatgtgaatatttttattgcttatccttaaactgcttacctgaatcactattgagtgtcataagtaatgactgtgaaacagtccaatgctttccctagatatccctcttttctccaaccagtatgaccaaatctatcca

SEQ ID NO: 346096 - DNA, 253 bp, Homo sapiens
aattccacttaacgctggaagcacgcagacgctcttgaggcgggcagctgcgtagcgtgtggaggagccgggagagcgcaccccaatgtggcacctgagcgtctgggaccgaaccagcatggggagtcggaaggggacaaatccgcgatcccagtcatgcatgtgagactgggcaaaggaaggctcgagtgtgtgtgagaccgcggtgggcctgcttgtgctggtgggatgaggggtgtctgggtagttgagt

SEQ ID NO: 346097 - DNA, 458 bp, Homo sapiens
ttgccctttttttcatattgctcatatttgagaattttctaagccattcacttctcatatgctttacttcaagattttctatatctattttagaagttgtattgctttttgtacatacaaccgtatgatgtttttaccttcttatttttcagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcct

SEQ ID NO: 346098 - DNA, 1718 bp, Homo sapiens
acaggcagccaactccagtttttcgcccaatatatgccccactccctgcagtgcccctttccagcctttcccctttcatctatagggattataattatttttaaaaatttcaccattaatacttggaattattctttccaacagttgatgatgttcagggatgtggctgtagatttctctcaggaggagtgggagtgcctggacctggaacagagggatttatatagagatgtgatgttggagaactacagcaacatggtctcactgggtaagattcagcattttccttagaaattcctgctttctgtattgtgattttttttattgtcttttaaatgtccagggtaacttctgacctttgttttttagaaaatggtttgcgctttgtaaatctggcaatagttatcatcagtgggcacttccatctttcccatagtttatacttatttttgtcctgcctgtaattgtttctcttccttagtaaccaaagaagtagttgcaaattttagaatctttacaatgtggttctttgctgtttctcatcttctgggcaggtttttgcatttatcagccagaagcgttctctttattggagaaagggaaagagccctggaagattttgagggatgagacaagaggaccttgcccagacatgcagtcgaggtgtcagaccaagaagttattaccaaaaaatggcatttttgagagagaaatagcccaattggaaataatgagaatttgtaaaaaccacagccttgactgtttatgttttagaggtgactgggaaggcaacactcagtttcaaacacttcaagataatcaagaggaatgcttcaagcaggtgatacgcacctgtgaaaaaaggcccacttttaaccagcatacagtgtttaatctacaccagagacttaatacaggagacaaactgaatgaatttaaagaactggggaaagcctttatttctggttcagatcatactcaacatcagttaattcacacaagtgagaaattctgtggagataaagaatgtgggaatacctttcttcctgattcagaagttattcaatatcagacagttcacactgttaagaaaacatatgaatgtaaagaatgtgggaagtcttttagtttacgttcgagtcttactggtcataagagaattcataccggtgagaaaccttttaaatgtaaggattgtgggaaagcctttagatttcattcacaacttagtgtccataagcgaattcatactggtgagaaatcttatgaatgtaaggaatgtgggaaggcctttagttgtggctcagatcttactcgacatcagagaattcatactggtgaaaaaccctatgaatgtaatgaatgtagaaaggcctttagtcagcgatcacatcttattaaacatcagagaattcacactggtgaaaaaccttatgaatgtaaggagtgtgggaaagcttttactcgtggatcacacctaactcagcatcagagaattcatactggtgagaaatctcatgagtgtaaggaatgtggaaaagcctttattcgtggttcaaatcttgctcaacatcagaatgttcatgttggtaggaaaccttataaatgtgagaaatgtgggaaagcctatatttggagctcacaccttgctcgacatcagcgaattcatactggcaggaaaccttatgaatgtaagcaatgcgggaagacttttactt

SEQ ID NO: 346099 - DNA, 268 bp, Homo sapiens
atgttttactttcttccccgtgcttctcaagtggtgagcttcttgagaaagggacatgaggtagtcactcgtgcatccctggagaatagtatatactgtctcaggcccggtgaatatcctttaaattgattgattaggaacgactcctcctttagaaccttttggtttttttaaatatttttatttttattttttgagatggaatcttgctctgtcacccaaggtgaagtacagtggcgcaatctcagctcactgcaacctctgcctc

SEQ ID NO: 346100 - DNA, 465 bp, Homo sapiens
taaaaaaaacccatacagagtactagagaaggatttcaaggaacatcttacagtgtgaatgattctagttatagtttattagaattcctttttgtttttccatatcgttatgccgctatatttagtctgtattaaacatttctaatcagttttttctctttttctttgtgtcattataatgcattttaaaatgtgatggctataggtttaatgagttaatctcacttggtgaatatgaaaaggcagcttgttatgcagcaaacagtcctagaagaattcttcgaaacattggtacaatgaatacatttaagggtaagcatttctctctgaaccttatatatgtatgaaaatttactactttttctctcataaaatagaaaaagcattaaactgggagactaaagatctaggccccagccctatctctaccatttactctgtatggggatatggtacgcgagctcc

SEQ ID NO: 346101 - DNA, 506 bp, Homo sapiens
tcacataagccttgattttcataatgcagacagtattctctatatggctgtaggaatataagacttcagtggtgtttgcatagtaactcctttttcaccttctactacaagagcccctcttgtagctggggagtgcacccacaagatctaacagctgtttcagagctgctcattttagagtgattggtagggagttggtggctcaaaggtcctaatcagaatgtgtcctgggttctgaatgactagcagactatcattaaccaaagtgctgggattacaggcatgaaccaccatgcccggcccaatttggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttg

SEQ ID NO: 346102 - DNA, 211 bp, Homo sapiens
agacagggtttcccatgttggccagactggtttcaaactcctaacctcaggcaatccacctgctttggcctcccaaagtactggaattacaggtgtgaaccatcgtgcccagcccaatttgctgttggaaaaattagaggaaagcctcttccattactcttattttttgaggccctctttatcacaagtcatgcttttccatgtcctgttg

SEQ ID NO: 346103 - DNA, 3030 bp, Homo sapiens
  misc_feature (680)..(680): n is a, c, g, or t
tgaggtcctggacgaggtgcttctgtgctctgaacctcagtttccccatctaaatcagggcgatgcctggcaagagctggtgagggctgacctggaggacctgggctgccctgcccattcccttccgggggtgatgattgccttggcttgcagtgccaggcctttgcctgtattatcagcaatcctgacggttctgttagattggcactgttatgcctgcttacagatgagcaaactgaggctggaaggtgggggaccaggtagctggaagtgggcgaactccaacccagctctgagctcagtaccctgtcctgtcccctcgatgggctgccccgcctgtcacctcacctcatcagtgtggcatgtgtcaggcactggaccagggacacctcgctgaggaagaaatggctctgcccttcccggatgttctgtgatgggcaggcagctgagggcaccgtcttgggttcgcagatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccaggtgagccgatggccgccagctggggtgcctagggcctgggccagggagnctgggcgccccgcagcccccaagtttctcccatggtgttggtgccaacaatgtgggtgtgaacgtgtctctcacactcccgccgtgtaagttcgtcgttgagggtgtggcatcaacaccactgtctccctggagagcaggcagcccgcggtgggcgggggctcgcctcccccatcctgaggtacaggagactcacatgcccgattgacatttcagagagacgtcttcaaccagctgctgattcacgcggccttaaactgcacctccagcgtccataagaacgtagcccggtgagctcctggcccctgcccagcactcccgaccttcacaggctctccctgcagacctcaggagtgcctggaagccccaccacccttggcccgagatgctcctgcttctgaggctgtgaggtcgggaggctgtggggaatttggttctcctttgttagcaggctcagtgtgaccaagtggagccagccccaccccaggcccaacctcccacccttcccagcccactcccttttagccttgctaagctacctgggtacgtaaacacgtcctgctctttcaggctcctgggcctttgcacgcttggaacaccctttctccttttttgcacctggccgacacctaatgctcagttagacctcagctcatttcacctgcctgcctgtgctgggtaccgagagggagcagtgagcaggcacaccagtcactggctaccaggagcccatctgtagtcgggggagcgacagggagcaatcagtcccacagacacgtaaactcgcactgagggagcagcagctgagggcagacccgaaaccacagtgggtttagccaggccaggcatggggctggtaggagggtggcgtggctggagggtgagtgttagggtggcatggctggagggtgagtgtgttagggcagcgtggctggagggtgttaggagggtggtgtggctggagggtgagtgttaggagggtggcgtggctggagggtgagtgttaggagggtggcgtggctggaaggtgtgttagggtggcgtggctggagggtgagtgttaggagggtggtgtggctggcaggcgagtgtcaggagggtggcatagctggcagatgagagtgctgggggaactccaaagagccctcaccattgccagcagccttggtgcttccatggcccagcttgcctccctccacttaggctgctgagctcttggccagcagctgcgtagcccgtgtgcctgagcggcgagtttgacacctctccttgcccatgtccctgccaccctcagacataagtgaaaggaagaatagaggagtcatggggtgcctggtggggaaggtgtgctgtgagagcaggtggcagcccgggtccacaggaggcccttggctggtgacaagcccagtggtttaggcgcaggtgcaccagcgcagctccctccaggcagggttacccaaactgagctgtacaggttctgtggtactcatgaaacaggtctggctggcagcactggaaccgcctagaactgtaaaatgtcttggacgcatgctccccgctttccccttccatggctgtagacaaaaccatgcgtgtttctttggtggtcaagccccctggggagctcaggctgtggtgtgggtgggagttggtgcctctggcagcagcggtggggaaagtggctgtgtggacaggagggctgaggatggagctggggtgacatctgtggggcagtgcggcagtgccgatgtggccttctgcggggcccagtgggggagggcagggggagagcaggctgcacagggagccgactgcattaggagacgtggagggggccttctctccaagtcctgtcctgctaccaggcagcatccatggggccatcagcacagctcaccagcccccaaggtgggaaaccttccacccacagccatggtgccccccacaatgagttcccggccccagccccttcacaccacccacgccctctagaaccactgttttcaggtgtttgggggctgtcttagtcagtttgggttgttattttaaaagtgccacagacaggccgggcacggtggctcatgcctgtaatcccagcactttcggaggccaaggcgggtggatcacctgaggtcaggagttcaagaccagcctggctaatatggtgaaactccgcctctactaaaaatacaaaaaattagccgggcgtggtggtgggtacctgtaatcccggctagtcgggagcctgaggcaggagaatcgcttgaacctgggaggtggaggttgcagtgagccgagatcgcgtcattgcactccagcctgagtgaccgagggagattctatctcaaaaa

SEQ ID NO: 346104 - DNA, 1036 bp, Homo sapiens
cccttagagacctgccgtcgcctgccccggcagcctgactgatctgctttatctggaatcctcttccccgcaccctgcgtaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacgtaagttgcattcacaccgtgtttggtttgttgcagcattttgcctttgagtctcaaagagaccagatttttgagttcatcaggattgtcccagccagaaaaacagctggagcaagaacacatttcttgtgtaaggcctcatggggttaattttgccaagagcaatgttgtaaccctgcctatgatggggacagtggttggccctgctcaactcgagggtgctgatagatttacacatctaagggcctcacctctgcaattgtggactctcctccagccctttcagatcacttttctttggtaagacaactggtctacccataggaattttttttttttttgagacagagtttcgctcttgttgcccaggctggagtgcaatggtgcgattggctggaattttttttctttgctgtgataaaataaaaataacataaaattacgtgtacaaggccgggtgtggtggctcacacctgtaatcccagtaatttgggagtccgaggcaggtggatcatttgaggtcaggagttcaagaccagcctggccaacatggtgaaacgctgtctctactaaaaatacaaaaaaattagctaggcgtggtggtgggcacctgtaatcccagctactcggggggctgaggcacgagaatcacttgaacccaggaggcagaggttacagtgagccaagatcacgctactgcactccagcctgggtgacagagtgagactctgtctc

SEQ ID NO: 346105 - DNA, 548 bp, Homo sapiens
ttgtactggaggacgtgggagggtggggacatatctctgccccccccccacagcgtcctaaaagggcctctgcactctcccttcttccccaggactctgagtggtgggtggacagcggtgggtgcagtggggatgttttttgaggatgctggcctccccgggcctcccattgtggcctgctgagggtctgatgcagggctcggctgcttaggacgtgggatcctgtcctgggatgaatctgtgagtatactgccttcacctaggctgtgcctttagaactaggagaagtctcagaagtaagatccaactagcttccttgacaagtggggaaactgaggctcagagttgaacctacttgacttgaaggttgtccatgaattacaggcagaaccaggatgaacctgggcctaactgcactgatagaaacctaagctgaccttggcgtgggtggtgaggcccctgcatactgacttcatccacataacaggaggactcaggtagctcttagaagcctacgggctgaacaagagaggactgatggaatgctg

SEQ ID NO: 346106 - DNA, 2536 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346107 - DNA, 2772 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccaggactctgagtggtgggtggacagcggtgggtgcagtggggatgttttttgaggatgctggcctccccgggcctcccattgtggcctgctgagggtctgatgcagggctcggctgcttaggacgtgggatcctgtcctgggatgaatcttatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346108 - DNA, 2450 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatggctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346109 - DNA, 2012 bp, Homo sapiens
cccttagagacctgccgtcgcctgccccggcagcctgactgatctgctttatctggaatcctcttccccgcaccctgcgtaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346110 - DNA, 1665 bp, Homo sapiens
ataagggcactaatcccattcacaagggccccaccctcatgacttaatcacctccaagaggccctgttcttaataccatcaccttgggcatttgggcttcaacatatacatttagcctggacacagacattcagtccacagcagggtctttacctcaaaccgtacctgggtcttctctcttcaaacctgggttttccccactgccacctgttgtgccccatctcgggtgtggcttcctgcactggaggtctgtgccctcccatcctcacctctccccaaactgaggccaggcctcctgcccctgggccttggcccttgctgttccctcagtgccgcagtctagcctgcctgtgttctgccttgggaccaagggaccaccaggccccacatccctctagaaggttctgtaacaggacctctgtgtctgtttccacaggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346111 - DNA, 2167 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagcccctgtgtggattcacaaccttttcgatcggcgcatggggcctctgtgccttggggggtttgagccccgggggctcttggtctgttgcccgttcttaggccttaaggtttg

SEQ ID NO: 346112 - DNA, 1648 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacgtaagttgcattcacaccgtgtttggtttgttgcagcattttgcctttgagtctcaaagagaccagatttttgagttcatcaggattgtcccagccagaaaaacagctggagcaagaacacatttcttgtgtaaggcctcatggggttaattttgccaagagcaatgttgtaaccctgcctatgatggggacagtggttggccctgctcaactcgagggtgctgatagatttacacatctaagggcctcacctctgcaattgtggactctcctccagccctttcagatcacttttctttggtaagacaactggtctacccataggaattttttttttttttgagacagagtttcgctcttgttgcccaggctggagtgcaatggtgcgattggctggaattttttttctttgctgtgataaaataaaaataacataaaattacgtgtacaaggccgggtgtggtggctcacacctgtaatcccagtaatttgggagtccgaggcaggtggatcatttgaggtcaggagttcaagaccagcctggccaacatggtgaaacgctgtctctactaaaaatacaaaaaaattagctaggcgtggtggtgggcacctgtaatcccagctactcggggggctgaggcacgagaatcacttgaacccaggaggcagaggttacagtgagccaagatcacgctactgcactccagcctgggtgacagagtgagactctgtctc

SEQ ID NO: 346113 - DNA, 184 bp, Homo sapiens
cctcccattgtggcctgctgagggtctgatgcagggctcggctgcttaggacgtgggatcctgtcctgggatgaatctgtgagtatactgccttcacctaggctgtgccaagaccttctgccacattaccagtcatttctctaccaatgaagggtcctatagtttagaactaggagaagtctca

SEQ ID NO: 346114 - DNA, 430 bp, Homo sapiens
ggcctggtcaggaggagcgagcagcctcttcaaagcacatgagctgcaccatgacggggaccctctgtgggatgtggaaacgcagaggaagcattaaactcaactgggcttggggggacagtggctagggaaggcatcctggagggggcaacctctgagttggctactgaaggatgagcaggtgtgtgccacacagagggggaagatggagggcatcctagcccgtcactagcttgagcaaggcctccaaggcctacagtggcctgtgagggagaggagagctgcttactttggtgtcctagagcccaggtacaaggcggacatgggctgtgcaggaggccttgtcagtccctctttccaggggaggcaaggtggtgtccaggcagaggcagaaacgcctgcagaggcctcagggaaggaaaggctagca

SEQ ID NO: 346115 - DNA, 2624 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346116 - DNA, 2750 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccgaggcaaggtctcactcggtcatccaggttggaatgcagtggtgtgatcacagttcactgtaaactcaaactcctgggctcaaggaatcttcctgcctcatccttccatcgtgcagggattacaggggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346117 - DNA, 2467 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgctggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346118 - DNA, 2490 bp, Homo sapiens
tttgttagaatgatccaagggctccgtgaggacttgttttgcttttcccatttcagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346119 - DNA, 2049 bp, Homo sapiens
caatacctatattaactttccactaggagagagaatgcttccacagcaactgtttcttcagtggtggcggcacaggtgctgctgtgctttctacactggggaaccaaagccccggttggaagcgggttcaccttctcccatcccgaatgccaccaagacaccgtccgtccacctctgagaggaggtggaggccggagaccatgtgctcaggggtctttggcctggccgttctcagttcacgtgccagcattacactttgccttctccagggtttaataaggagaactttattcttccagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggagccttctgatggagcgtgatgccttgaagcccaactcgcccctgaccgagcggctcatccgcaaggcagctaccgtccacctcatgcagtgagccagcctggccgcctccaccctgcagaacctcagtggtggcgtcactgcgtccagtcagctgctccaccgggttagggtcaggagacggccagagcctgtttgttagggctgttagagggtgatcttcagttttacaggaagtgggtcacgggttaattttaaatgtgattccgaatctcctttcagtcctcgagaagggccaatgagcatttttcagcagtcacagccagtgtgagtgctgctctttccacctgccttgcaaattctgtttcccaggggaatgtgtctactgcctggtggttcaaaggttggaaggcagggcagaggtgggggctgattctgctgggacaggtcttccagaggcagcctccccccactgcctgtccccgtccccaccaggctgcccttgggatggaccttttcattcttttctttatattctagacagtctctgttgtctcattgtgttgctgtcccatttttcaggtgagggtaccggggtaggggagtggcctgcccagggtcacactatgagaggcccccacctgctgcctttggacgcagccccctgctgctgcatccaccacccttcttacagatcagcgcgcacatggggtccttctgctgtctctggggcgagtcttggagccccctggggggctctgttggtgctgatttggacccgtttctctttttaaactgcacatcataacagggcttcatgtcgagcatgattttaatcataaatgcacttctgaggtgcaaggattgagctcagagctgctctgttgtggcaaaacccaaagtgctgtgatgtgtggctgtgacaagcctggagcgggtcctgtgagcgccgcctctgtctcctgcttccccactgaacgcctgctgaatgtgccgctgactcagctgtgctgctttcagccctcctgtgaggggcggtcccagtgcacagatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346120 - DNA, 3456 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaaggactctgatatgttggcttgtcataactattggcactgggctttatatctgattgagaagggcgaatatgaggccgcgctgaccatctacgatacccacatccttcccagcctgcaggccaacgatgcaatgctggacgtggtggacagctgctccatgctctaccgcctgcagatggaaggagtgtctgtgggccagcggtggcaggatgtcctgcctgtggcccggaagcacagccgagaccacatcctgctgttcaatgacgcacacttcctgatggcatccctgggtgcacacgacccccagaccacacaggagctgctgaccaccctgcgggacgccagcgaatccccaggggagaactgccagcacctcctggcccgagacgtggggctgcccctgtgccaggccctggtggaggctgaggacgggaaccctgaccgcgtcctggagctgctcctgcccatccgctaccggatcgtccagctcggtgggagcaatgcccagagagacgtcttcaaccagctgctgattcacgcggccttaaactgcacctccagcgtccataagaacgtagcccggtgagctcctggcccctgcccagcactcccgaccttcacaggctctccctgcagacctcaggagtgcctggaagccccaccacccttggcccgagatgctcctgcttctgaggctgtgaggtcgggaggctgtggggaatttggttctcctttgttagcaggctcagtgtgaccaagtggagccagccccaccccaggcccaacctcccacccttcccagcccactcccttttagccttgctaagctacctgggtacgtaaacacgtcctgctctttcaggctcctgggcctttgcacgcttggaacaccctttctccttttttgcacctggccgacacctaatgctcagttagacctcagctcatttcacctgcctgcctgtgctgggtaccgagagggagcagtgagcaggcacaccagtcactggctaccaggagcccatctgtagtcgggggagcgacagggagcaatcagtcccacagacacgtaaactcgcactgagggagcagcagctgagggcagacccgaaaccacagtgggtttagccaggccaggcatggggctggtaggagggtggcgtggctggagggtgagtgttagggtggcatggctggagggtgagtgtgttagggcagcgtggctggagggtgttaggagggtggtgtggctggagggtgagtgttaggagggtggcgtggctggagggtgagtgttaggagggtggcgtggctggaaggtgtgttagggtggcgtggctggagggtgagtgttaggagggtggtgtggctggcaggcgagtgtcaggagggtggcatagctggcagatgagagtgctgggggaactccaaagagccctcaccattgccagcagccttggtgcttccatggcccagcttgcctccctccacttaggctgctgagctcttggccagcagctgcgtagcccgtgtgcctgagcggcgagtttgacacctctccttgcccatgtccctgccaccctcagacataagtgaaaggaagaatagaggagtcatggggtgcctggtggggaaggtgtgctgtgagagcaggtggcagcccgggtccacaggaggcccttggctggtgacaagcccagtggtttaggcgcaggtgcaccagcgcagctccctccaggcagggttacccaaactgagctgtacaggttctgtggtactcatgaaacaggtctggctggcagcactggaaccgcctagaactgtaaaatgtcttggacgcatgctccccgctttccccttccatggctgtagacaaaaccatgcgtgtttctttggtggtcaagccccctggggagctcaggctgtggtgtgggtgggagttggtgcctctggcagcagcggtggggaaagtggctgtgtggacaggagggctgaggatggagctggggtgacatctgtggggcagtgcggcagtgccgatgtggccttctgcggggcccagtgggggagggcagggggagagcaggctgcacagggagccgactgcattaggagacgtggagggggccttctctccaagtcctgtcctgctaccaggcagcatccatggggccatcagcacagctcaccagcccccaaggtgggaaaccttccacccacagccatggtgccccccacaatgagttcccggccccagccccttcacaccacccacgccctctagaaccactgttttcaggtgtttgggggctgtcttagtcagtttgggttgttattttaaaagtgccacagacaggccgggcacggtggctcatgcctgtaatcccagcactttcggaggccaaggcgggtggatcacctgaggtcaggagttcaagaccagcctggctaatatggtgaaactccgcctctactaaaaatacaaaaaattagccgggcgtggtggtgggtacctgtaatcccggctagtcgggagcctgaggcaggagaatcgcttgaacctgggaggtggaggttgcagtgagccgagatcgcgtcattgcactccagcctgagtgaccgagggagattctatctcaaaaa

SEQ ID NO: 346121 - DNA, 1063 bp, Homo sapiens
ccctttccgcgaccgccccgcccactcccaggaaggcccgggtgcccagagctcgcggtggactccgacccggcgcaacatggccgcagcctcgcctctgcgcgactgccaggcctggaaggatgcgaggctcccgctctccaccacaagcaacgaagcctgcaagctgttcgatgccacgctgacccagtatgtaaaatggaccaatgacaagagtctcggtggcatcgagggctgcctgtcaaagctcaaagcagcagatccaacctttgtgatgggccacgccatggctactggccttgtgctgattggcactggaagctccgtgaagctggacaaagagctggacctggctgtgaagacaatggtggagatttcaagaacccagccgctgacaaggcgggagcagctgcacgtgtctgcagtagagacatttgccaatgggaactttccgaaagcctgtgaactatgggaacagattctccaggaccacccgacagacatgttggccctgaaattttcccatgatgcttatttttacctgggctatcaggaacagatgagagattctgttgctcgaatttaccccttctggacacctgacatccccctaagcagctatgtgaaaggcatctactcttttggcttgatggaaaccaacttctacgaccaggcagaaaaactcgccaaagaggctttatctattaacccgacagacgcatggtcggtgcacaccgtcgctcacatccacgagatgaaagcagagatcaaggatgggttggaattcatgcagcactcagagaccctctggaagggcctggtcaggaggagcgagcagcctcttcaaagcacatgagctgcaccatgacggggaccctctgtgggatgtttttcaagttcctcagtttgtactgaaattagggattcatcagggcaggaagcaggcaggcctctcagaagggagaggaggcctccaaatctattgagtccccacagtttgctcaagcccaggcaaatttctgtgattaaaatgaattcatcagttcctccaaaaaaaaaagca

SEQ ID NO: 346122 - DNA, 254 bp, Homo sapiens
tgacatctcatgggaaatttaggaaccaactttttccactccataaaatcctatttatagaatttcttttgtgttcatccttctctgtgcagaaaagaagctttttttttcttctggagaggattctataatgtgaaagctaacaaatgatcaatatttattttttaaaaaccacactacctaaacatctaagggggcaagaagacaactccagtttaaaatgtatgacttcgaaaggccattgacatccaagg

SEQ ID NO: 346123 - DNA, 714 bp, Homo sapiens
tgctgaggggccgggcgggctaggggccggctagccgccgttcgcccctgctttgcatattcatgaagtctagcgaggccggtcgcccaggctagccgtggacgggtcatgaattattcatgaggaaacctctggtcccgcccagaaaggcctcgttgactattcatgagccgaggagcgggtttgggccggaaaaggccgttgacccccggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacgtaagaatgtttttacacttacactggaatcaaaggcttgtcttttattctttaaaaaaagaaattagacatttattttgtttttgtgtttaacagtataagtgtctacgtttgcatccataaactaatttcttatcttatgtct

SEQ ID NO: 346124 - DNA, 2113 bp, Homo sapiens
tgctgaggggccgggcgggctaggggccggctagccgccgttcgcccctgctttgcatattcatgaagtctagcgaggccggtcgcccaggctagccgtggacgggtcatgaattattcatgaggaaacctctggtcccgcccagaaaggcctcgttgactattcatgagccgaggagcgggtttgggccggaaaaggccgttgacccccggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaaaaattttt

SEQ ID NO: 346125 - DNA, 2076 bp, Homo sapiens
tgctgaggggccgggcgggctaggggccggctagccgccgttcgcccctgctttgcatattcatgaagtctagcgaggccggtcgcccaggctagccgtggacgggtcatgaattattcatgaggaaacctctggtcccgcccagaaaggcctcgttgactattcatgagccgaggagcgggtttgggccggaaaaggccgttgacccccggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggtaagtaatagaaattctatactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaaaaattttt

SEQ ID NO: 346126 - DNA, 720 bp, Homo sapiens
tgtaaagaagggattaaaccatgccgttgacaagttaacttacccctgggctccttgaaggcttgtcagtttagtctttggaggtccccgagtaccattttaagtgttaccatgttactgctgctgagtaatagtgcaagtgctaaaatgcaaaattcagatggtacagggtttggaaatcatgcagattcagatgcagaaaaaaaaaattaaaacaactcaagatccctttacagaggaaactgaataatgaaacaatgtggcgattacaagtctaaaggatgacttcattgataaatgtttatgtaacttgcaaaatgacaaacctatttatcataatctaattaggtaagggcattaggtaaactaccaacacaacaaatatcacattcttccaactagaaaatgagctcaactctcacagaattagttacaaaaaagtacaacagagaatcaatgttattgcttttacatacttaacaatgcattgtgagagtgtgagttttgtaagcgattttattcaactgtattcaatgttaccacattcccccacctcctggaggacaaagcccattccacttaacacttccagacagacaacccaccctaattcttaaagctatcaggcctcttaatggatttcaggcacaagataatttgtggtttcttctactttatccctactgcaattaattccacttttcaaatcccaaactagga

SEQ ID NO: 346127 - DNA, 536 bp, Homo sapiens
aaaagcctcattaccaagcattccagttagtcaagatttgactgtatattcctttcagtggcaacttgcccccaggtgagatttccatccatttcatgataaattccaacagatacattttccccccttcatcaactgtgtgtgaagaaagggtgaaggcagggtcccctgggatggattctgatgttctaatgaaatgatggctcctacgaattccacttttgagtggtcactaatttccttaatgcacaagagaccctaaactaagcttcaaagcttgactgaggtgttccctattgtgtgtaaataatgctttaaaaaccatgtgtcacaacgcagtggctggtggtgccctggactctctgagggcttcgccctgtctcggcatgtttcaagggacgatggtagatgtacggcagtgatgtgagtctatgtgcagcattgtgggtgcagtggtttgccttctttcagaaacgcatacttcccactcctttgactttgccaaagatggtatagcagacatttgacatagcaga

SEQ ID NO: 346128 - DNA, 460 bp, Homo sapiens
atgattatttctatgcttaactgattttcttctgaaaaaataaatttttatgtagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtca

SEQ ID NO: 346129 - DNA, 424 bp, Homo sapiens
gtttgggggtacatgtgaagaaggtttcctgtataggtaaactcgggccgtggaggtttgtcatacagattatttcatcacccaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtca

SEQ ID NO: 346130 - DNA, 5488 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346131 - DNA, 5422 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346132 - DNA, 5356 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346133 - DNA, 4735 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaaggttaatcttttttagcatccctttacataaagtaccatagaaagtgctgtggccctagagagatggataaaacaaagcatctgctctcccgggataaaaagaagaaaggccattttgtgaagagatgaagactgagcggttgtggccgccttgccgaccttgagcagcagttggcttctccacatagtacccgggaataggagtctcagaatcgaatctcttctgcctgctcacttctgtgagatttttttgatcttcagctacatttttggctttgtgag

SEQ ID NO: 346134 - DNA, 1046 bp, Homo sapiens
atattatttcgcaaagcataaagcacgtaaatactcaggttacgcatgttgagctgaatgagcttctcctttgtgcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346135 - DNA, 5692 bp, Homo sapiens
gtccctaacggtcttcggaagcgaagcagtgtcaacagtccctggtaaacacaagtagtattacaagtcgggagctcttcaagtcttggatgagactgtagagcggtcttgtgcggcaatgtgctaccttaaaataaataaataaataaacccctgttatgtccggagtttgtttccacccggagaggaatggaagagcaccagagagcgcttagctttctggttggatgttttgggctctgaggtcagcttggagaagaaaaaaaagattaagatgccagtgaagagacttcgtgaggtagtttctcaaaatcatggagatcatttggttttgctgaaagatgagttgccctgtgttcctccggcattgtctgcaaataaacgtcttcctgttggaacggggactagtttgaatggaacatcacgtggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346136 - DNA, 4859 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagtttcaccaggtgatatggatcggacacaaattgagcttaatccgtacctcacatgtgtattttcaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtca

SEQ ID NO: 346137 - DNA, 5153 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346138 - DNA, 4666 bp, Homo sapiens
agcggagggcagtgggtgttgacctgcgggcaactgacgctgttgtcagattacacccacgacggtgcgggtctcgggcgttctggagatacgtaggggtgaatttatgtttccgacgattgcatctggaggggttcatcagacttaacttctgctagaaattgttaccagcctctattagaaaatcccatggtgtcagaaagtgatttttctaaagacgttgcagtgcaagtgttgcctttggataaaatagaagagaacaacaagcaaaaagcaaatgacatcttcatttctcagtatacaatgggacagaaagatgctctaagaacagttttaaagcaaaaagacagggtttgccatgttgcccagctggtcttgaactcctgggctcaagcagtcttcctgcctcagcctcccacagtgctaggattacagagctcaaagcatgcctgtttttaaggaagtaaaggtacatctgttagaagatgcaggcatagagaaggatgctgttactcaggagactagaatttcacccagtggaattgattcagctacaaccgtggctgcagcaactgctgctgccattgcaaccgcagctccgttgataaaggtgcagagtgatttggaagcaaaagtcaattctgttacagaattacttagtaaattacaggagactgataaacacctgcaacgtgttacagagcagcaaacaagcattcagaggaaacaagagaaattacattgtcatgatcacgaaaagcaaatgaatgtgtttatggagcagcacataaggcatcttgaaaagttacaacaacaacaaatagatattcagactcattttattagtgctgcactcaagactagtagttttcagcctgttagtatgccctcctccagagcagtggaaaagtattccgtaaaaccagaacaccctaatcttggtagctgtaatccatctttatataacacatttgcttccaaacaagcacctttaaaagaagttgaagatacgagttttgataaacagaaatctcctttggagacaccagcacctcgcagatttgctcctgtacctgtttcaagggatgatgaactatcaaagagggaaaatcttttggaagaaaaagaaaatatggaagtgtcatgtcacagaggaaatgtaagactattggaacaaattttgaataataatgattctttgacaagaaaaagtgaatcatcaaacaccacctcactaactaggtcaaaaataggatggactcctgagaaaacaaacagatttccttcctgtgaagagctagaaacaactaaagtgactatgcagaagtctgatgatgttcttcatgaccttggccaaaaagagaaagaaacaaatagcatggtccagccaaaagaatctctgagtatgttgaagcttccagatcttccacagaattctgttaagcttcaaacaaccaatacaacaagatctgtattgaaagatgctgagaagattttgagaggagtacaaaacaataaaaaagtacttgaagaaaacctggaagctattattcgtgcaaaagatggagctgccatgtattcgcttatcaatgctttatctaccaacagagagatgtcagagaaaattaggatcagaaagacagtggatgaatggattaaaactatttctgcagaaattcaggatgaactgtcaagaacagattatgaacaaaaaagatttgatcagaagaatcagagaaccaagaaaggtcagaatatgactaaagatattagaaccaacacacaagataaaactgtcaacaaatctgtaattccaagaaaacattctcaaaagcaaatagaagagcattttagaaatctacctatgaggggcatgcctgcttcaagtttacagaaagagagaaaggaagggcttttgaaagcaaccacagtaatacaagatgaagattatatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccacctgctggagtgattgtcagcaagccacaccctgtaactgtgactacttctattcctccatcatctcgaaaagtagaaactggagtaaagaaacctaacatagccattgtagaaatgaagtcagaaaaaaaggatcctcctcagcttactgtgcaggtattacccagtgtagatattgacagcatttcaaatagtagtgctgatgtcctttcacctctgtctagccccaaagaagcatctcctcctcctgtgcaaacttggataaagactccagaaattatgaaggtagatgaagaagaggtgaagtttccaggaactaactttgatgaaataatcgatgtcatacaggaagaagaaaaatgtgatgaaattccagactctgaaccaattctggagtttaacagaagtgttaaagctgattctacaaaatataatggtcctccatttccgccagttgcttctacttttcagcccactgctgatattctggataaagtaattgagagaaaagaaacactggaaaatagcttaattcaatgggtagagcaagaaataatgtcaagaattatctctgggctctttccagtccagcaacagattgcacctagtatcagtgtttcagtcagtgagacaagtgaaccactgacttctgacattgtggaaggaacaagcagtggcgccctccagctttttgttgatgctggtgttcctgtgaactcaaatgtgattaaacattttgttaacgaagctcttgctgagaccattgctgtcatgctgggtgacagagaagcaaagaagcaaggtcctgttgctacaggtgtttctggggatgcttcaacaaatgaaacatatttgccggcaagagtgtgcaccccactggctaccccacagcctacgcctccttgctcaccttcatcacctgctaaggagtgtgttttggtaaagactccagattcttctccctgtgattcggatcatgatatggcttttcctgtgaaagaaatatgtgctgaaaaaggagatgatatgcctgccatcatgcttgttaatactccaacagttacccctactactacacctcctccagcggcggcagtttttaccccaactttgtcagatatttccattgataaattgaaggtatcaagcccagagcttcccaagccatggggtgatggagacctgccactggaagaagagaaccctaactcacctcaagaagaacttcatccaagagctattgtaatgtctgtggctaaggatgaagaaccagagagtatggatttccctgctcagcctccacctccagagccagttccctttatgccatttcctgccggcaccaaggccccttccccctcacagatgccaggttctgattcatcaacactggagagcacattgagtgttactgtcactgaaactgaaactttagataaacccatctctgaaggagagattttatttagctgtggtcaaaaattggcccccaagattttagaagatataggactgtacctgacaaaccttaatgatagcttatccagcactctgcatgatgccgttgaaatggaggatgatcctcctagtgaagggcaagtgattaggatgtcccataaaaaatttcatgcagatgcaattctttcttttgctaaacaaaaccaggagtcagcagtttcccagcaagcagtctatcattcagaggacttggaaaacagtgtgggtgaacttagtgaaggacaaagaccccagctaacagcggcagcagagaacatcttaatgggacattctctctatatgcagccacctgtcactaatacacagtctttggatcaacaatgtgatcctaaaccattatctcggcaatttgacacagtttcaggtagtatttatgaagattcatgtgctagtcatggtccaatgagtttgggagaattggagttggagccaaattctaagctggttcttcccacaacacttctgacagcacaagaaaatgatgttaatttaccagtagccgctgaagatttttcccagtaccaactaaagcaaaatcaggatgttaagcaagttgaacacaaaccatcacaaagttacctacgtgttagaaataaatctgatattgcaccttcacagcaacaagttttgatcagcaggataaagaattgtaagaactgacaaacttgagaagcagttttcaagttgtgttgacctagttgtaggccgtgtttgctgttttaatcatcaactgcagagcacaatactcacccttccagtaaacctcgtaaatcaacaagtgagaattatgaagccacttacttgttataagaataaaagtggtcaactctgatactg

SEQ ID NO: 346139 - DNA, 1053 bp, Homo sapiens
gtttgggggtacatgtgaagaaggtttcctgtataggtaaactcgggccgtggaggtttgtcatacagattatttcatcacccaggtgggaaagcagtgccactctccgcttcacagatgccccctgccaagatgtcagtgatgctgccgtcagtgaacctcgaggactgctctcagtctctgagtctcagcacaatgcaggaggacatggagtcttcgggggcagataccttctgaacgggaagagacagccagcacagtgtttatgccactggttttaaagtcattttaccttggcttaaaaccctctctcagactgtttggtttttgagcatattctgaaaaaaaaattccaatattttaaaataaaacaaaaagcataatttgggtatttaaagtttttaaataaaataagtataagtcattataagtctgattgtgagttgtttcttagaatcctgagatagcatagagtagtgaaagggcatggcttttgacatctaggcatttaatctataggtgtaattatctgtatgtatttataaaattatgtagctcaaggttattcattctaacatttttataacagcaaatagaaaaaatcaaatgtctatcaataatagactggttttaaagtgatggtacatcagtacaatggaatactatgtattacaaaaaaaaatttaaaaagtttattgatatggaataatctttgagatgcactgttaaagtgaaaaaagccatgtgcaaaatagtgtgtgaactatgcagttgttgaaattatttaaaatggggtggggaggaattcaaatgtatggtatgtcacatattcttacatgtatttgcttgtaaatatattatataaacaagaaactgtctaagtttgtctccagggagtagaattgttggctgggtgataggagaggctaagtgataggaatcaaggataatcgtggttactatgtatttgaacttcagttgtgatagaaaaaaatcatcagtgagattaatttttatatgccttatgtataccatataaacctttataaacct

SEQ ID NO: 346140 - DNA, 278 bp, Homo sapiens
aggtccttccccagacacctgaagagatgggggaaggagaatcaatttggagagccaagtttgcctgacattttggagcacacatttacccaggaccccaagttccttgtagctgctaaatgctgtactagttctaaaatgtaaattagcttcaagatgtttccatgaagaaaaatcccgccttcaacttctacgttattcatcctgcttttagaaatgacccttgccctgatctgaggtggaagaaataaaggtctggtaaagaaatgatatgctta

SEQ ID NO: 346141 - DNA, 632 bp, Homo sapiens
gtggatacatttaaaaattatcatgtaggtaatttagagtatgtcattctatgtctttgctagaaatgataccaaaatattattttttaaaaattaggttattttttgaataagtggtatattcatggcagagaatttagaaaaggcagatacaaggaaattaatttttaaaataacctataattttatcacctagagaaaatctgtcagtagtttaaggtatttctttctagatttttctagattttaattatctttcaaagttgggatcatactgtatatagaaattggaaaggaccactactgttcccatcaacatagcataaataataatcattgaaagaaaattttagatctttctagcagagtgagtcaagtagccaagtattttcaatgatttcatctggttaaagcattgtgacatttccttaaccttttgctgtaagtattatagtatttagaactaattatttacaaattaaacacagattctgtgtggaaggaaagttgcttgagtattgtcaccttaatgattgtatattggtcattgtactggaaattatccagtgcaaaataggatatcatcaactataaaagaaaataagaagtagtcatttaatttgtatggctag

SEQ ID NO: 346142 - DNA, 198 bp, Homo sapiens
atagacacacacaacacgcacaccacacacacaaaacactccacatcgacacacaactcacgcacaaaccacacacacacaacatgccacataggcacacacaccacgcacaccacacacacacaaaacactccatgtcgacacacaaatcacacacaaaccacacacacaaaacactccacatagacacacatacca

SEQ ID NO: 346143 - DNA, 449 bp, Homo sapiens
taaaattcagggaagtgatggtgtgtgacttgtgacactagatccgaaaagacacggtgatgtctgacttgttctcttggatgtctctccctgagtgaagccagctacttttcatgaggatactcaagcattcctatggagagatccacatggtgagaaactgaagcctcctaccaagagccagcaccaacttgccagctatgtgaatgagccatcttagaagtgggttctctagccctagtcaggccttcatatgactgcagccagggctgatattttgactacaacctcatgagagactgagccacaacaacctagctaagaagctcctgaattccctaccaacagaaactatgtgagataatgtttgttgttttaactaagttttcaagtggtaatttgttatacagaatatgtaactaataaagcatggctcctttaggtctaaa

SEQ ID NO: 346144 - DNA, 211 bp, Homo sapiens
cagtgcaattcaccaccataaagaattaaaagagactaatcatatagtcatcttataagagggtaagggagacacctgataaaatgtgtaactgttattcctgattaagctcctagcaaactaagaactgaatggaacttccctgacttgataaggccatctactactgcagctactatgaaacttaacagcgatgcactggaagcattct

SEQ ID NO: 346145 - DNA, 740 bp, Homo sapiens
cctcctatgctgcatcctgcctgtggtttagatttgagatagggacccctactttctttcccctaagagcagatctgtgtcattggctataactgctttctggtcagccacatgacacgtggacttaacagatggtttctaataagattgaaagcatatcttgactccacttacctggccagcactggagaaaggaagattaagagagatttggatgagtgtccttgtcacataacttcccctccctagaaaacttggtccaatacgttgtaatctggtggtgcaaactcacaacttttcttcccttctgtgagtgtgtatatatgtgagtttattgtatgtgtgtgtaaggtgtgaatgtgtatgtgaagtctgtgtgtgatgtgtgtatatttgaatgtcctgtgcatgagtttttttgtgactgaagtgtgtgtgaggtgtctgtatgtgggatgtgtgtgtctgtgaggtgattgtgtatgaggaatgtacatctgtgtctgtggtatatagaaaacgtgtgtgtggtgtatgcacttgctgtgtctgcatatgcatgaattgagtatgtgacttgagtattgtgtgtgtaggaggaggggggaagtaaaaaggcaaggtgacagtagagactggacaaatgaacatagccgggcactattcctttaactcctagaacagacataacttgaagtgatctagacttgaactttggagtatgaagttccagccagctg

SEQ ID NO: 346146 - DNA, 1098 bp, Homo sapiens
aagtgattctcctgcctcagcttcctgagtagctgggattacaggcatgtgccgccgtgcccggctaatttgtatttttagtagagatggggtttcaccatgttggccaggctggtctcaaactcctgacctcaggtgaccccacccgcctcggcctcccaaagtgctgggattacaggcgtcagccactgcgcctggctgagtctgtgctcttaaccatcacattatactgattctcataggccactatagtaatgtgcttagtgtgtatctctatgtgtttttgcaaaatctgtatttaatttatataaatggtattgtgttatagatctcatttcacctcttactatttttttttttgagacagagtctcgctgtagtgtgcagtggtgcaatctcagctcactgcaacctcccaagttcaagcgattcttctgcctcagcctcccgactagctgagataataggtgcccaccaccacgcctggcgaatttttgtatttttggtagagacggggtttcaccatgttggccaggctggtctcaaacttctgacttcaactgatccacctgtctcagcctcccaaagtgttgggattacaggcgtgagccactgtgccccaccacttttttttttcgaagctctatgttttaaaacccatccgtgtttctccaccgctgatggaacttgtgcctgctttccatgggggcagcacccaccattatacttgtcccctctctgtgtgcgaagggctcaccagccttcaggactggccacctctgtagcctctccttcagtccttccctgcatctagcctgggctctagaagtgctgacttcccagtacatcctagaatgtgcaccagtatgtcacgcctctgtgcctttgttcttcaaggccagtggaatatcccggatcacctagttccaatctcctcattttacagaatcatcctacattttacagaggaggagaataagcttagaaacaatgacctgcttgagaccgtacaaccagaaccccaccctttatctctggccagcctcttctccctcttctctttagtcctcctctgctgctcactggccgaagtcccct

SEQ ID NO: 346147 - DNA, 485 bp, Homo sapiens
ggctcggtaccgtactgcgctggatatgccggctccaggaatgtatgctcatctggttgccctgcagcaccacatccggcctgctttccatgggggcagcacccaccattatacttgtcccctctctgtgtgcgaagggctcaccagccttcaggactggccacctctgtagcctctccttcagtccttccctgcatctagcctgggctctagaagtgctgacttcccagtacatcctagaatgtgcaccagtatgtcacgcctctgtgcctttgttcttcaaggccagtggaatatcccggatcacctagttccaatctcctcattttacagaatcatcctacattttacagaggaggagaataagcttagaaacaatgacctgcttgagaccgtacaaccagaaccccaccctttatctctggccagcctcttctccctcttctctttagtcctcctctgctgctcactggccgaagtcccct

SEQ ID NO: 346148 - DNA, 579 bp, Homo sapiens
ctaaaggacccccgagcggttatgctgtatgcagaaggagcggatggattctagatggagcgcatgtcgcgaggtttgttctcaacacacacacagagaccaagacacgcacaagcatgtatatccattcatacataaacaaacacgcccacacaagctcacaggccaagagaaacagagacacagatacattcacaggcatacaaacattcataccttcaaatgtaccagtgccgacggacacaggccaggacacacgccagccatgacacatacctgcagaggtacatatgtacacgtgaaccccagacacactcacacccgaccagaaagcatatactttgaagcacagacagagggagcagcacacagaaacacagcagagatcagcagctctgccctggagctgccccctgctggccgtgtgaccccgggggttatgtcacctttctgtgcctcaattttgtcatctgccaaaagggatgataatggtctctccctcataggttgtggggcaggcgacatgagtcacttcacataaaacacataaagaaatctcatcacctcctttgagaatga

SEQ ID NO: 346149 - DNA, 553 bp, Homo sapiens
gtggccaggatgacatcctgggttccagcttgagcaaatggggagaggtttgttctcaacacacacacagagaccaagacacgcacaagcatgtatatccattcatacataaacaaacacgcccacacaagctcacaggccaagagaaacagagacacagatacattcacaggcatacaaacattcataccttcaaatgtaccagtgccgacggacacaggccaggacacacgccagccatgacacatacctgcagaggtacatatgtacacgtgaaccccagacacactcacacccgaccagaaagcatatactttgaagcacagacagagggagcagcacacagaaacacagcagagatcagcagctctgccctggagctgccccctgctggccgtgtgaccccgggggttatgtcacctttctgtgcctcaattttgtcatctgccaaaagggatgataatggtctctccctcataggttgtggggcaggcgacatgagtcacttcacataaaacacataaagaaatctcatcacctcctttgagaatga

SEQ ID NO: 346150 - DNA, 375 bp, Homo sapiens
cccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttctta

SEQ ID NO: 346151 - DNA, 466 bp, Homo sapiens
acatggacactgtgttcattcagcaccgtcgttcacagctggagttcaccttaggtcccctgcctggaccctcagccagatgctggccccaaacctctttccttgcttccctaggtcagggacaccagtcccatcctcagacaccagcttgggtggatgtcggctctgggacccacaaaagctaacagcccccaggactgaagagcccttgggtatcatagagcatcttagaaaatgggtgatgcaaggccgggtgtggtggctcacgcctgtaatcccagcattttaggaggccagggcaggaggatcacctgaggtcgggagttccagaccagcctgaccaacatggaaaaaccctgtctctactaaaaatacaaaattagctgggcgtggtggcgcatgcctgtagtcccagctactcgggaggctgaggcaggagaatcacttgaatccaggaggctgaggt

SEQ ID NO: 346152 - DNA, 405 bp, Homo sapiens
tctacgaggatcagacttagaaccctcacagagatgatacggttgtcgtaatgagggtgtttcagtgcctctgcaacgctgctggccccttcggaggggcccagccacatctccactctagccggggtgctgagctcactgtccaagaagctccaatgtatggaggagtggttaaagttcagtggggcctgggggaagtggcaaggatgttggaatactctgggctgcgtgctcctgtctgcccctttttacccctttccctctaggttcagctttctttttcttttttcttttttttttttgagatggagtctcgctctgtcgcccaggctggagtgcagtggtgtgatctcggcttactgcaacctccaccttccgggttcaagcgattctcctgagtagctg

SEQ ID NO: 346153 - DNA, 245 bp, Homo sapiens
gtgccaggctctttttaaacaaccggatcttgtgtgaactcattaccacagaaagggcaccaagccatgcataagggactcgcccccatgacaccagcacctcccacaaggccccacctccaacattgaggaatcacatttcaacatgagatttggagggggcaaacatctaaactatatcaaaagtcgatgattaaacacagtctcatataaatgttctacctcaaaaaaacccaaacattgca

SEQ ID NO: 346154 - DNA, 1369 bp, Homo sapiens
ggcagctttgcaagtccgcgttatatatcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggagacacagccttcatcatcctgcgtaagcggccactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaa

SEQ ID NO: 346155 - DNA, 1305 bp, Homo sapiens
ggcagctttgcaagtccgcgttatatatcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcgcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaa

SEQ ID NO: 346156 - DNA, 456 bp, Homo sapiens
gggtgcattccacagcccctgccccgaggaggtctgagaaggtgaaggaaggccagatgcagagagacagggaatgacaaatgacagctcagatttctcccatggccatgattatgggattctctgcctggggggcagggggcaatagcagtccccacagagaagagcaggacatgggattgggggaggccatgcagggaatgggaggggacaggagccctactttcttgcctttggctctgtccctgtatctgcggcctcagagctcaggtgctaccaagagaccctcacaggagtgacccaggacaggcctcacctccctctaggcctcagtcttcctgtctacaatcagccagtccccaaggtcctgctaggcccatggactcctggcagatggctctgcagggtctgtggggtaaagatggtctcttgagggctccctgacagattcttcgt

SEQ ID NO: 346157 - DNA, 651 bp, Homo sapiens
ggacgttcaggtaatcaaattaaaggaaagctcactatggataaggttagttttgaaacatttcatacagaggttagttatgagacacatcttaagtgtttcaagaattcagactggcagaaaggtagaaggaacagcaaagaggtaagaatcaattgaatgtcccagacaataagaacatcacactgaggaacagtgggaggagactgaataggtgaaacgggtccacatcacaggagtcctggaagggcagggctgagtgggctcttctttgatgctatagacaacaccaccaaaggaaaggctcttgaggagggaaatgacaacataagagccctattttaaacaacttaatcttatcacagtataaaggatggagcagattagagataagacgaccaagaatagatacgctagcacaacagtcttcatgaaaggctaacaaacatggggaaaaaaggttcacactcattaataatcaaagacatgcaaattaaaactataaaacaccattttctggcttaaaaaattagtaaataataaaaactaataatactagcaaagataaagcaatctcaaacactgttggtgggaatataaatggaacggtctttatggaaagccattcagcaatatgcattaataatttta

SEQ ID NO: 346158 - DNA, 690 bp, Homo sapiens
gatcaggttttccaagattttctgaatggatgtggttcccctagtagacctggcttcccatctcccatgttaaggaagatcttctttattaatcccctggctcactagagatcaggaaccccagtgggtagaatgttcagctcccaaggaagatatgctgcagaggcacatggcaaactgcttaaaagaaaaaaacaaaacaaaacaaaaaaagcttgtagtcaacagacatgtgaagagtccctcccatccaatccagaagcttaagtaataatttgagaatctgtacccagtaggaagttagccctaagtctcacccaggtcaccagagggcagttatactttccaattctgcctagaacctccacgcttcagtgcaggacttttaaaaattaaaattatatggagagtctgataaagatttgactttgaaaaatttgggggaagaaaggaaccagacacccaataccaccctcagatagggcatggcttctgaacatgcaccaaatgccacagcactgcatgagttgaaaaatgaagaggacatcattttttcattaatgcttttaggaatttcttttagaagggaaggaaaaagaaattcaaaaaaggtggctctttggggaaaaaaaaaaaatgaaagttgtgaaatgtaataccagaaaggttttgcttaccagaaaccgtagc

SEQ ID NO: 346159 - DNA, 638 bp, Homo sapiens
gagaactatttcctgtgactaaaagtggtttacatattggtgctttagcaggaattttggagggtggcttaagtgaataattaaaacagaaatcttcctagacgatgtttatcacactcaagacattaaaaattagagtcaagggactgctaagacttggggtgctggtgggtgaggctgcctttcagggaggccatgctgtgagttgagaatcctaggccaccttgcctgcactgccagctttgcagctgtgggcacatctggatccccatttctgtgcgggtgcagacaggtgaatgttacctgcgtgcatcattagggctcactggcttgcatgataagggatgctgggcacggtaaacacagaaggagaaggcaggctctgctgccaggagcttgcaccctgagccacgtggaactggtttgcctgtgaagcaataggcacagtcctgaaagagcacagtcctgaaagagcacttctaattgggcatacaagcaagctcataataaagttctcctaagaaggtttcctcatgttttgaagatgatacacttagtccctgactggggatggtttcgcttacactttttcaactttacgatggtgtgaaagtgatacacgttcagtacgttcctca

SEQ ID NO: 346160 - DNA, 819 bp, Homo sapiens
ctgtttcagaaacccttggtgaactcttaaagccctgaagagcttaaaaaatgctctgaagagatctgagagtcgcagttaaggactctcaaagaacctcaaagaaaagccaacttagcctttttatacaattaactagatttgggtcttaaattctactttgacatataggcctaagaggtagtttaacatggccttgttacccttaccccttctgttctgtgctgttttctgagaaacggatgcaggaactgattccctttcttcctctctggaacaggatataaagaacccttccgcttccctttacttgtggccttcctggccaggcttatgtatactgaacaaagctagggtgcagtgcttctgagctagctgttaggggtccacagccagaaggaatgggagaccacaggagccattcaaaagataattacatgtcagaagagagtccatccatggggttctgttaaagtagacaccttcacgttgggagacataggctttgtctgcttgctgggctgaaccctcaccatatccacagagaacaaaatggggagcagctgtaccaggggagggatgaacgtctttcacccaagttgccagtctgctagttgtctggaaatgttcaagggaggctaaggtatcttgtcttatgatgtctcaggaaacagggttggttctcagctggcagtgaagggggactggtgtggtattagcagttgaacttgaggttgcaatctcaagtcaccctctggcctcgcaggaatgcaccagggtgatttgggaggatctgagtttcctttatgaagtcagatt

SEQ ID NO: 346161 - DNA, 311 bp, Homo sapiens
ttttttttttaaacctcttaaaagttgatgtatatatatccttaccactaagcatatcttttcaattaggcatgtggcaattcctttcttgatgtttttagggaaaatgagccaaataatattttaaaaaatgtataagccaagctagtttctatcctttcttctattaaactcaggatcacacaagtaggcatgagtgtgcacaaatatttatgccttgcattgttctgagaattagtaaaagaatatcttgaaagcatgatataactttgtatttgtatccaaaaatatacaaagttgttgaattaaaa

SEQ ID NO: 346162 - DNA, 1218 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346163 - DNA, 633 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggtgagtgaggagcgctgttggccggcgcgggggtggccgcggggagcagcaacagtggaggatggatgagtgaccctgagagttacggcccggagtctaaagcattggtttgtcagccttctaaaattaatgtggaagtacgagagaatataccagaacgttcttgtagcgaattaaattatctccagacttaaaaaaaaaaaaaaaagagaaaagaaaaaataaaaataaagtggacagcaggctaaacaaaaaatattaccactaaaagggagccgcaagatagataaggagcgttaaccacagatttatatgtggaccaaaaggtgactacccaatataggagaagagcggtataattgaagccgaggacatcggggcctctgcattacacagtcttagtgaccgggggaaa

SEQ ID NO: 346164 - DNA, 1246 bp, Homo sapiens
  misc_feature (1225)..(1225): n is a, c, g, or t
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatactaaaaaaancacacaaccaaacaaaaaact

SEQ ID NO: 346165 - DNA, 1192 bp, Homo sapiens
ggatatcgtcgacccaggcgccgtcgggcgcggctccgtgttgctcctcgtggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346166 - DNA, 1242 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttgggtgagcagcctcgcgggctggcggctcgagcgggggacggcccgggcccgttccccgctgaccttgccgcttcccgtagggtgaacaacccgttcttgcctcaggccagtcgcctccaggccaagagggatccttcacccgtgtctggtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346167 - DNA, 1200 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346168 - DNA, 1152 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346169 - DNA, 1857 bp, Homo sapiens
ggctgactgggacctggcccggggagactttgcccaggctgcccagcagctgtggctggccctgcgggcactgggccggccctgcccacctccaaacttggacctggcttgtagcctcctctggaacctatccccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatactaccttctgggttaagaaaattccattcaaataacattctcatgtaaatactcaaacatacagattgaggcttccagaaattaatccacttgaggcgtccacgcggaacaaggtctgctgaccacagttacacacgtcgtgacaccactgtatcacggcgaatgtcgaacactagagttacagacgacaggcaacaagaacatgcagagccggccgccagccagctcctacgccccgtgcccgccatggccacaggggggagctgctgggcgcgcctccacctcagcctccacggggcaccttccagccactgctgtgcctcagccacctaggagccatccctgaggccatggccaccaagacaggtgagggaggccccagggcacacagccccaggatcttgcccccatttccaaccctggcagcgctgccagccattctttggtcttcccactgctcacctgtcctcagagccagtactgatctaggggagcaggtgccacctccatctcccagctgtccccccacccctggggctccccagctctaccaccccggaagctgagccctggagacaccctgaggggcgggcgccacctccttcccagaaagagcagagcagctggcagactagagctcagctgctcctgaccactgacaaccgggagatgtctcggcagacaccacttatcccagaaaagaccagaggctccaaatgggaaccaagtgcataaatacaaataaaaacagagtttacacatcgatgacagtagcacaaaatatacgtaatttctagatactgagctaataaatcactgtagttaaaaacaaaatagattcactgaaaccaagtcgatagttaccttggagtagtggactagctgcagaatgtcacggacccacttcctttaaaacaacagaatgttgctatcagtttgtcttacgttaaaacagttcttaaaccacctactatattaaatacattctaatttggtcactgatgataaagatttttacctagacgttttgcacttaaaaaatgctattaaaagtctttggcaaagccacggtcggggagaaacacgtcggtgccgcttcccactcgtgtgccctcaccacccacgtggcccgcggagagccaggtcgccgtaaaccacagatgcctgttcctgctcaactcctagggacagtcccagccctgagcagaagggtcaggtcatcgcggggatgcgttctcagtcacgtttctgctgcggccgaaaccacactgtcgctccaggtcccagctctgctgtggtcccctgtcccgtctgcccctggagcgacagtcacgtttaatgctgcctcgtgcc

SEQ ID NO: 346170 - DNA, 785 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaatctgagggatcctaagcacttcaagtcagagaagacaggacgggcacagttgagggaaggctggagagatagtcatcagccta

SEQ ID NO: 346171 - DNA, 441 bp, Homo sapiens
agaccttccgctggaacgcctacagtgggatcctcgggtgagtggggccggggcagggatcccaaagcagcagcgcagctccccacccggcctcacgtgccgtgcccgtgtctccccagcatctggcacgagtgggagatcgccaacaacaccttcacgggcatgtggatgagggacggtgacgcctgccgttcccggagccggcagagcaagggggcctcagacgggagcccgggaagaggggccccagtctccccaacccacctacccacgttccctccccaggtggagctggcgtgtggaaaaagcaaccggctggcccatgtgtccgagccgagcacctgcgtctacgcgctgacgttcgagacccccctcgtctgccacccccacgccttgctaggtaggggtgcgggacgcagttgagcccagtggggtcagccg

SEQ ID NO: 346172 - DNA, 227 bp, Homo sapiens
gagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346173 - DNA, 2568 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatactaccttctgggttaagaaaattccattcaaataacattctcatgtaaatactcaaacatacagattgaggcttccagaaattaatccacttgaggcgtccacgcggaacaaggtctgctgaccacagttacacacgtcgtgacaccactgtatcacggcgaatgtcgaacactagagttacagacgacaggcaacaagaacatgcagagccggccgccagccagctcctacgccccgtgcccgccatggccacaggggggagctgctgggcgcgcctccacctcagcctccacggggcaccttccagccactgctgtgcctcagccacctaggagccatccctgaggccatggccaccaagacaggtgagggaggccccagggcacacagccccaggatcttgcccccatttccaaccctggcagcgctgccagccattctttggtcttcccactgctcacctgtcctcagagccagtactgatctaggggagcaggtgccacctccatctcccagctgtccccccacccctggggctccccagctctaccaccccggaagctgagccctggagacaccctgaggggcgggcgccacctccttcccagaaagagcagagcagctggcagactagagctcagctgctcctgaccactgacaaccgggagatgtctcggcagacaccacttatcccagaaaagaccagaggctccaaatgggaaccaagtgcataaatacaaataaaaacagagtttacacatcgatgacagtagcacaaaatatacgtaatttctagatactgagctaataaatcactgtagttaaaaacaaaatagattcactgaaaccaagtcgatagttaccttggagtagtggactagctgcagaatgtcacggacccacttcctttaaaacaacagaatgttgctatcagtttgtcttacgttaaaacagttcttaaaccacctactatattaaatacattctaatttggtcactgatgataaagatttttacctagacgttttgcacttaaaaaatgctattaaaagtctttggcaaagccacggtcggggagaaacacgtcggtgccgcttcccactcgtgtgccctcaccacccacgtggcccgcggagagccaggtcgccgtaaaccacagatgcctgttcctgctcaactcctagggacagtcccagccctgagcagaagggtcaggtcatcgcggggatgcgttctcagtcacgtttctgctgcggccgaaaccacactgtcgctccaggtcccagctctgctgtggtcccctgtcccgtctgcccctggagcgacagtcacgtttaatgctgcctcgtgcc

SEQ ID NO: 346174 - DNA, 1268 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatactaaaaaaaacaacacacaccaaccatactacataaaaagcaactaaaaacgg

SEQ ID NO: 346175 - DNA, 1297 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttgggtgagcagcctcgcgggctggcggctcgagcgggggacggcccgggcccgttccccgctgaccttgccgcttcccgtagggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346176 - DNA, 1351 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctgagacggggtttcaccgtgttagccaggacggtctcgatctcctgacctcgtgatctgcccgcctcggcctcccacagtgctgggatgacagtcatgagccaccgcgcctggcctcgactttattattaatacggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346177 - DNA, 1187 bp, Homo sapiens
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaagtggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatacta

SEQ ID NO: 346178 - DNA, 491 bp, Homo sapiens
  misc_feature (461)..(461): n is a, c, g, or t
  misc_feature (463)..(463): n is a, c, g, or t
agcggacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaagagctggcgtntncgagcccgagcaactgcgtctaaggggt

SEQ ID NO: 346179 - DNA, 1421 bp, Homo sapiens
cacttaattgtaaattaagatttgctgatgatgatgggctaatttaagctaccgtggaaagagggaagaaatggaagctgctgatcgtaggaagcagtacctgtactgcgcagggttgcagtgacctaacaccaagaaataaaaactctggaaaactagcccttcacatatggaaggaccctcccaaagagctggagctcctctgcccactgcctcccccatcagatcagacctatggtagaagacagcaaggagtaaacgctgtttcctgttttcatttttttcaactggaccaccagctactacaaccctagaaaaatggaggcacagatatgtgggtcccagagccctgggggagctggaatggatactcgctaacacacgggacacgagattctctttcctttggaagggtcctgtccatggcccttcttgggttctggactgtcctacaatgcctgactttagtttctgtggatcatgataagcattattcattttttccccctcaaatatcccacagcttcaaacttacctgaatgcaggttccctgtaaaaataccatcatgtaatttgcacattagcaatcagtttgatgaatggcaaaatcgttcaaatggaaaagaggagagagatagtgtggtcttttgatggagggggagaggcaagagccagataaatcagaagagagaggcgaggctcttgcagcccaagtcttaatttccttgtaagaatcgatgctcactcagtggtgacactgagcttgtgaaagctcaactgtgacactctttagaaagtagtacagagatttttttccttcccattatcaactcattaaaggaagttaaaagtacttactctgtcccacacacagtgtgtgtgtgacaatgtcggaaacattgactgactcataataaatttgagattggataacaatttatactacctttatacctctctcctcgccccaaattgaatcattaaaaaacatttagtaagatcgaatgtgcagttctgtgggcagaactccacaagtcaaaatactcctgaatttaaatactcctgaggtttaacaaattactctgcaatgcaatttgggattttactctaaggaagtacaacagaggcacactcccttaatttccattgccctgtcacagatcagttgcctaacattcttcccatagcatagctcccagttgttgcatgtagaaaagcgctccactgattctaacttgaaaggtgtgtgactcgtgtgtgctcaaagagcatgtgacgatcaacataatgaaaagtcaaacattgttttgttgtgttgttccctacctctttcttggaggtctcttcatcttcaattcccatgagctggcctggttcaccatctggctgttggaaaggaaactaaacacattttctttctt

SEQ ID NO: 346180 - DNA, 801 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346181 - DNA, 1172 bp, Homo sapiens
  misc_feature (1)..(1): n is a, c, g, or t
  misc_feature (47)..(47): n is a, c, g, or t
  misc_feature (206)..(206): n is a, c, g, or t
ntgagttgggaggtttgtttgattttgtttttggtggtaggagatangtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcnggccctgactgtggcacttctgcttcacctgcccactgggttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggtaattactgaattataattttaaaaagtctcaaagtcagcattttggaagtggtactttcatagatttttaaattccataatgtgccttatcttttcattgcaggatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346182 - DNA, 631 bp, Homo sapiens
  misc_feature (23)..(23): n is a, c, g, or t
  misc_feature (41)..(41): n is a, c, g, or t
  misc_feature (43)..(43): n is a, c, g, or t
  misc_feature (52)..(52): n is a, c, g, or t
gcgggagcgccgccctggcccgnaaggtttgtatttggaangncgcttcgtnttcctaaagcgatttcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346183 - DNA, 852 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtaacaacaaccaccccccccccaggggggggcgcccaaaagttccccccgggg

SEQ ID NO: 346184 - DNA, 456 bp, Homo sapiens
  misc_feature (1)..(1): n is a, c, g, or t
  misc_feature (25)..(25): n is a, c, g, or t
  misc_feature (39)..(39): n is a, c, g, or t
ncccaaccccgattccgcgcgcggnccccacttccgggnaacatcttacctccggctcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346185 - DNA, 749 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaattcatctactttattttgatgtttccttaatgtgtaatttacttattataagcatgatcttttaaaaatatatttggcttttaaagta

SEQ ID NO: 346186 - DNA, 426 bp, Homo sapiens
tgatatataataggggtccaattgtcgccaggacaagaaagacttgatgggtactattggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346187 - DNA, 386 bp, Homo sapiens
  misc_feature (1)..(1): n is a, c, g, or t
  misc_feature (10)..(10): n is a, c, g, or t
  misc_feature (15)..(15): n is a, c, g, or t
  misc_feature (23)..(23): n is a, c, g, or t
  misc_feature (35)..(35): n is a, c, g, or t
  misc_feature (49)..(49): n is a, c, g, or t
nggtgcggtngaaanaagccaantcttgtgggganccctgaaaaaccgntgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346188 - DNA, 1513 bp, Homo sapiens
  misc_feature (1)..(1): n is a, c, g, or t
  misc_feature (47)..(47): n is a, c, g, or t
  misc_feature (206)..(206): n is a, c, g, or t
ntgagttgggaggtttgtttgattttgtttttggtggtaggagatangtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcnggccctgactgtggcacttctgcttcacctgcccactgggttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtaaaaaaaaaaaaaaaaaaaaaaaaaaaaaaaaaaagggggggggggctaaaaaatttccccgggggggcccaatttaatgcggttacccggtttcttttgtcaaaggctgcgccccaaatgaggaagcggaatttataagcaaggcaaggggcgcgcgtttcaaacaacgctgctcgacgggcgaaaaccttgcctcgcgtgggcactctttcgggagaaggagacccctacactccgggggggggcgcaccactattcggggcacaacctacctactcaggagaagattttaaaagcgcttcaagaggggacacattatacagcctctttacagcggtggtactaacggctctcaacaacacgcggccataatatatgtctcgcggcttcaaaacagattttcggtacaccggaggatttaacttttgagacaatattttaccgag

SEQ ID NO: 346189 - DNA, 667 bp, Homo sapiens
tgcttgactcctgagaccgcggtgtgtggctggagcaagaacacagaggccaggcagagcagcggacgttctgcgtgggactcgcccctaacagctttggaagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346190 - DNA, 707 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagtgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346191 - DNA, 1191 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtaaaaaaacacatccccactaatatccgcggtctccaaccctatcctccctccactatgatgccgcccgcacggtaaacaaaaagagatctttccgaatcatagcttcgccaaaatcacatctcagaaatagaaagaacacaccgaaccataaaacaaacaactgagcccgcgcacatcaaccataaaatatccgcttacacctacatattgaacccactattctcctacacccacataataccacgtacatcaaatagaccacacccgtatactctttactattacgccccccccgatatcccctctatctatttcaatacccctacaccataaatacaccctgttgggaacgcgggggcgaccgcttcgacacaccactccgaaaataat

SEQ ID NO: 346192 - DNA, 948 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtaaaacatatagaataaaactcgagggggggccccgggtcccaattcggccctattagggggccgtattacaattccattggccgttcgtttttcaaaagtttggacttgggaaaaaaccttgcggtttccccaatttaatcgttcttt

SEQ ID NO: 346193 - DNA, 822 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccaatgacagaccaaagttacacaagcctccagaaccttacaggcggtgttcctccggctcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346194 - DNA, 789 bp, Homo sapiens
cttgtaatccttatgaaaggattatacttgtagtccctatgaaacacatatgtataccaagtctatttctaaagcctacacattaatttccatttttctaagaaattaagtcaaagatcaaaatctaaagattcaaatctaatttaaagattcaaatagaggccaggcgtgagccactgagcccagccaagtggggcatgagttttctcataaagccagcagggcagagtgattcctagtatagcagggcatgtgttacactcatgtcacttttagcaaatccacgttgccttttcagcaaaattcattacagagttaagaaaaacatgccctggtaattttctgttagaaggggcaaagattttgagtccaccacagtgcacatcatgtcagcatcattgctttttgtgtctttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346195 - DNA, 1179 bp, Homo sapiens
cttgtaatccttatgaaaggattatacttgtagtccctatgaaacacatatgtataccaagtctatttctaaagcctacacattaatttccatttttctaagaaattaagtcaaagatcaaaatctaaagattcaaatctaatttaaagattcaaatagaggccaggcgtgagccactgagcccagccaagtggggcatgagttttctcataaagccagcagggcagagtgattcctagtatagcagggcatgtgttacactcatgtcacttttagcaaatccacgttgccttttcagcaaaattcattacagagttaagaaaaacatgccctggtaattttctgttagaaggggcaaagattttgagtccaccacagtgcacatcatgtcagcatcattgctttttgtgtctttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtaaaaaaacacatccccactaatatccgcggtctccaaccctatcctccctccactatgatgccgcccgcacggtaaacaaaaagagatctttccgaatcatagcttcgccaaaatcacatctcagaaatagaaagaacacaccgaaccataaaacaaacaactgagcccgcgcacatcaaccataaaatatccgcttacacctacatattgaacccactattctcctacacccacataataccacgtacatcaaatagaccacacccgtatactctttactattacgccccccccgatatcccctctatctatttcaatacccctacaccataaatacaccctgttgggaacgcgggggcgaccgcttcgacacaccactccgaaaataat

SEQ ID NO: 346196 - DNA, 471 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccaatgacagaccaaagtgaaacaagcctccagaaactctagtcactactattgattctattccagttggtggaccaactgggtgataccgctattccggaccggctc

SEQ ID NO: 346197 - DNA, 851 bp, Homo sapiens
  misc_feature (814)..(814): n is a, c, g, or t
  misc_feature (824)..(824): n is a, c, g, or t
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtaaaaaaaagaaganaaaaaagttntgggcgccccgcccccagaaaacttaa

SEQ ID NO: 346198 - DNA, 407 bp, Homo sapiens
  misc_feature (1)..(1): n is a, c, g, or t
  misc_feature (16)..(17): n is a, c, g, or t
  misc_feature (37)..(37): n is a, c, g, or t
ngttcggggaaaaaanncacttctttgatctattccnttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346199 - DNA, 739 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaacctccggctcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346200 - DNA, 750 bp, Homo sapiens
agtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 346201 - DNA, 1624 bp, Homo sapiens
acagagtagctttgcaactggctttggggacttccgaaagctaccagcactgcactgtgagactctcatccctgagctgaattcatctgattcgacggcaagctttggtgagaacatagatatatttctgaggaaaatggactcagacttctcacatgccttccagaaggaactcacctgcgtcatctgtttgaactacctggtagaccctgtcaccatctgctgtgggcacagcttctgtaggccctgtctctgcctttcgtgggaggaagcccaaagtcctgcaaactgccctgcatgcagggaaccatcaccgaaaatggacttcaaaaccaatattcttctgaagaatttagtgaccattgccagaaaagccagtctctggcaattcctgagctctgagaaacaaatatgtgggacccataggcaaacaaagaagatgttctgtgacatggacaagagtctcctctgcttgctgtgctccaactctcaggagcacggggctcacaaacaccatcccatcgaagaggcagctgaggaacaccgggagaaactcttaaagcaaatgaggattttatggaaaaagattcaagaaaatcagagaaatctatatgaggagggaagaacagccttcctctggaggggcaatgtggttttacgggcacagatgatcaggaatgagtataggaagctgcatccggttctccataaggaagaaaaacaacatttagagagactgaacaaggaataccaagagatttttcagcaactccagagaagttgggtcaaaatggatcaaaagagtaaacacttgaaagaaatgtatcaggaactaatggaaatgtgtcataaaccagatgtggagctgctccaggatttgggagacatcgtggcaaggagtgagtccgtgctgctgcacatgccccagcctgtgaatccagagctcactgcaggacccatcactggactggtgtacaggctcaaccgcttccgagtggaaatttccttccattttgaagtaaccaatcacaatatcaggctctttgaggatgtgagaagttggatgtttagacgtggacctttgaattctgacagatctgactattttgctgcatggggagccagggtcttctcctttgggaaacactactgggagctggatgtggacaactcttgtgactgggctctgggagtctgtaacaactcctggataaggaagaatagcacaatggttaactctgaggacatatttcttcttttgtgtctgaaggtggataatcatttcaatctcttgaccacctccccagtgtttcctcactatatagagaaacctctgggccgggttggtgtgtttcttgattttgaaagtggaagtgtgagttttttgaatgtcaccaagagttccctcatatggagttacccagctggctccttaacttttcctgtcaggcctttcttttacactggccacagatgatcaggattaagaaaacttactgtttgggaactccatatacaagggagcccttcactgttgatacaaagaaatcatactgttcaggctttttttgtactttagtgtcacttcattttattgctattaaataaaaaatttgtaaaaggc

SEQ ID NO: 346202 - DNA, 1676 bp, Homo sapiens
acagagtagctttgcaactggctttggggacttccgaaagctaccagcactgcactgtgagactctcatccctgagctgaattcatctgattcgacggcaagctttggtgagaacatagatatatttctgaggaaaatggactcagacttctcacatgccttccagaaggaactcacctgcgtcatctgtttgaactacctggtagaccctgtcaccatctgctgtgggcacagcttctgtaggccctgtctctgcctttcgtgggaggaagcccaaagtcctgcaaactgccctgcatgcagggaaccatcaccgaaaatggacttcaaaaccaatattcttctgaagaatttagtgaccattgccagaaaagccagtctctggcaattcctgagctctgagaaacaaatatgtgggacccataggcaaacaaagaagatgttctgtgacatggacaagagtctcctctgcttgctgtgctccaactctcaggagcacggggctcacaaacaccatcccatcgaagaggcagctgaggaacaccgggagaaactcttaaagcaaatgaggattttatggaaaaagattcaagaaaatcagagaaatctatatgaggagggaagaacagccttcctctggaggggcaatgtggttttacgggcacagatgatcaggaatgagtataggaagctgcatccggttctccataaggaagaaaaacaacatttagagagactgaacaaggaataccaagagatttttcagcaactccagagaagttgggtcaaaatggatcaaaagagtaaacacttgaaagaaatgtatcaggaactaatggaaatgtgtcataaaccagatgtggagctgctccaggatttgggagacatcgtggcaaggagtgagtccgtgctgctgcacatgccccagcctgtgaatccagagctcactgcaggacccatcactggactggtgtacaggctcaaccgcttccgagtggaaatttccttccattttgaagtaaccaatcacaatatcaggctctttgaggatgtgagaagttggatgtttagacgtggacctttgaattctgacagatctgactattttgctgcatggggagccagggtcttctcctttgggaaacactactgggagctggatgtggacaactcttgtgactgggctctgggagtctgtaacaactcctggataaggaagaatagcacaatggttaactctgaggacatatttcttcttttgtgtctgaaggtggataatcatttcaatctcttgaccacctccccagtgtttcctcactatatagagaaacctctgggccgggttggtgtgtttcttgattttgaaagtggaagtgtgagttttttgaatgtcaccaagagttccctcatatggagttacccagctggctccttaacttttcctgtcaggcctttcttttacactggccacagatgatcaggattaagaaaacttactgtttgggaactccatatacaagggagcccttcactgttgatacaaagaaatcatactgttcaggctttttttgtactttagtgtcacttcattttattgctattaaataaaaaatttgtaaaaggcaaaactttttgtacattttcttacaattaaaataatctcttatggaccatta

SEQ ID NO: 346203 - DNA, 561 bp, Homo sapiens
ggttgcagtaagctgagatcatgccactgcactccagcctgcagcctgggcgacagagcgagagactccatctcagaaaaaaaaaaaaaaaaaggatttgcatactatgtttatgaattgaaattcatcctaaatgtgtcacttttctgttgggtggggtgactcatgcctgtaataccaggacgtataatcgtgccactgccctccagcctgggtgacagagtgagaccgtgtctttatttatttgagacagaatctctctctgtcactggagggaagtggtgtgatcatggcttcctgcagcctcaatcccctgggctcaagtgatcttcccacctcagcttcctgagtggctggaactataggcacctgtcatcatgcctggctaattttattgtctttttgtagagatgggatttcaccatcttgccctggctgttcttgaactcctgggctcaagctgtcctcccgcctcaagcctcccgaagtgctgggattacagactcgagccactgtgcccagccatagattccccaagtgggattgctaggtaaaagggtt

SEQ ID NO: 346204 - DNA, 337 bp, Homo sapiens
ttaaattataaaaattggctctcattgacttccaattaccaagatactgttgttggagcacagacctagctagatagcctcttttattgcattgcatatgagttaaaataaatgtcaggtaactaaggaaaatgccatgttatttttatacaacaacctagagaaagtattgtgagccaagagtagactttgtgattttcagtctctttctagacattccaactttagaatggattttagcagtgccttttgtgtaaatatacctttggtagataagaaatcctttcattcctgagcctggagtgtagggtcagttaactgaggagtagctgttatg

SEQ ID NO: 346205 - DNA, 446 bp, Homo sapiens
aatatatttttgtttactttgttttgactttccatgagttcatacctatacatgtctatactttgcatttgctgtttactctctttctggaatgtttttcctcaaaatatttctgaggcttagttccttacctctcttaggccttatccagacatctccttttattaagacatttcctaattactctattaaaactgaaacttcctctcctatacctatttcctgcctatccttgctcatggcttatctgttttcagagtttttatcaccttataaataacatatattttatgtttttgttgtcatgttctcactagagtacgagattcatctaggcagatttttttttttgtctggtttatttactactatgttctatcactgagaagagtgcctgacacgtggaagtagttgatgtgttaatgaataaatactatggtgactaa

SEQ ID NO: 346206 - DNA, 613 bp, Homo sapiens
tgagatagggtctcactctgtcaccggggttggagtgcagtggcacgatcttggctcactgcagccttgacctcccagggctcaagtaatcctcctacctcagtccccaccgggtagctgggactacatgcacgcaccaccatgccctgctaattttttttttcctgtattgtagagacgaggtctcactatgttgcccaggctggtctcgaactcctgggctcaagcaatctgcccgcctcaacctcccaaaatgttgggattacagacatgagccactgcgtccggccacgtacaaggtctctttaaatgatgaattggaaacatcagtatttcttcttttgcttaaattccagtcccctgccaacgtacactgccataccaagattaaatagagaagggcacccagaagcatctggttcgctgtaagcacttgacagctatcagctatgatcatcatttcttcttgctgatgttactggaacattgtggatgaagcagtgtttgccttaatcaatgggggcgagtttggaaggcctgccctccagggatgtcttagttccaggtgctgcaatttgcagtcctggaaatggagaaaggagataagcctgca

SEQ ID NO: 346207 - DNA, 729 bp, Homo sapiens
agttgcttgtgattaaataaccccaactgacgtggaaatcaaataaagcaacaaagaactgctttttcaactaacaaaatatacagctggatgtttgtcacaattctaatgtccctgcaaagatgagatgcatgaatcacacagcaatctcatcaaaaagtttatcttatgaggcataggagaagagaatcctggaaaaagcaagaagcaggaagataagaggcaaagaagaagagagccccacccactggggcaagctggggccccagatgatgaaactgtggcccagaaagtttaagggatgtgtcaaatgtcacacagctcacagatccagggacatggcttaaatccagatatcttgattctaacttcagttgaggaagagaaagagtgctgccccacgctgcctgatttacaacgtgaagtgaaatctttgaaaagaaaaataagacaatgtcactcaagctcttatctgaggatttcctgggtttgaagacagagctcaaactcatacaaggggtcatctgagtctgcagataggcttgctttatgctgctccgtcagatctcttctaaagattagtgcgcaattctggacattacattttaatggtaacatggattcaactaaagggtaagcaaaggacaccgacaggaatagggagggtgccatttatagagaaaagactgagaggtccatattgttattttacctgaaagatataataaa

SEQ ID NO: 346208 - DNA, 727 bp, Homo sapiens
aggaacagaaaaaaaaaggaatttgagacgggatctcagcatgtttgccaggatggtctcagtctcttgacctcgtgatccgcctaccttggactcccaaagtgttggaattacaggtgtgagccactgcgcccagccatcagaacaaaatatacagctggatgtttgtcacaattctaatgtccctgcaaagatgagatgcatgaatcacacagcaatctcatcaaaaagccctagcactacctctcagtatcttcatatccttcaatgatgaaactgtggcccagaaagtttaagggatgtgtcaaatgtcacacagctcacagatccagggacatggcttaaatccagatatcttgattctaacttcagttgaggaagagaaagagtgctgccccacgctgcctgatttacaacgtgaagtgaaatctttgaaaagaaaaataagacaatgtcactcaagctcttatctgaggatttcctgggtttgaagacagagctcaaactcatacaaggggtcatctgagtctgcagataggcttgctttatgctgctccgtcagatctcttctaaagattagtgcgcaattctggacattacattttaatggtaacatggattcaactaaagggtaagcaaaggacaccgacaggaatagggagggtgccatttatagagaaaagactgagaggtccatattgttattttacctgaaagatataataaa

SEQ ID NO: 346209 - DNA, 410 bp, Homo sapiens
gagattaagagacatgaggactaaaagagtcccattaggtgccctagcaagaagtaacatcacagggtcagtcaattacagggtattgtcaccataagtgcctgatatacatattaagggaaggcaagcgacactaccaaagtctactcacatccagccaaaagtcaaagtgaattcttaaaatagtgagtctttatattattatggttctttgcagttttcaaatgatttttacaatgtaagttatcatacctgattcaataagcccgcaagttcacccacatatgacgtccactttacagatgatgaaactgtggcccagaaagtttaagggatgtgtcaaatgtcacacagctcacagatccagggacatggcttaaatccagatatcttgattctaacttcagttg

SEQ ID NO: 346210 - DNA, 3451 bp, Homo sapiens
  misc_feature (799)..(799): n is a, c, g, or t
  misc_feature (825)..(825): n is a, c, g, or t
  misc_feature (1192)..(1192): n is a, c, g, or t
  misc_feature (2381)..(2381): n is a, c, g, or t
cctaatgttattcattaacacattttcatattatttaaattcttacaagcaacatttttaatgactgcatattttccatagtcattcctatatctccacttctttactgttataaataaagccataggacacgtttatgtataatcttatttttcacatttcaggtcatttttaacatggattcttagatgctgacaaatattgccaaattccattccaaaagaggttacacttatttcctttcatcagtgaatgagtatgcttattttcactgcacctttgacagctttatagtgtaatgattttttaaaaaattctatatagatgaaaaacaatgcttcggatgtttgggtttcgttttaatgtcactttaactgaagctatcttgtaaaattaaaagattgaaattaaagttatcagagtacattgctgatagttttccattgttttgaagtctgtatcctaaatgattaggtaataattccaaaaaatgccatacacactgtgtaattataaaaagaaatataataaaattttggggccatggtaatacctgtaataaattgagatcttacccctaaagtgggaacatggtagtttctaagtgacagtataacttgaccaacataatcgtacatcttttgaaattgctggtgatagagaattttatgtcagcggaaggaattaggatttaattatattatgtgtggcacagatatattttaaggctgaggttacctctccccattgtggtaaggaattcatgccgtttcctttttcagcttgcttgttagtgtgntagatctcagtttctaggtttttggnttttgttttttttttgtatttgtgtctttagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgaggtaggtattggcaggacagaaacttagaaaatttatactaaaatgcaagctagaagaggtattttatctaacccagagattggctggttgcttagttggtcttctacattgatataagagttgctaggctggatgtgttggctcacncctgtagtcttagcactttcggaggctgaggtggaaggattgcttaagcctaggagtttgagaccacactgggcaacatagcaagaccccatctctacaaattttcttttaaaaattatccaggtgtgatgtgtgccggtagtcctggctgtttgggaggctgaggtggaaggatcacttgagcccaggagtttgagatggcagtgagctgtgatcacataaccacttccgcctggagagcaagaccctgtctcaggggggaataaaaacgagttggcaggtttctttaactcttaggtttaaatagaggagatacttctctgaactttaaaacatttttgagaagagaggcaagcaaattcttactgttttttttatgtaggactttaggcaataataaatgtatcccttttagtttttaatgttttaatttcctaaatttattttctttatttttctaagctaatctgtgtcttagatcagaaatcctttgcgttttccagctctggtctgtatcctgggacaacagttgtagttgtgtttactctgcaggggtccctcgttttgtgatgcacatacttagaggaagttgatttctcctttccttgcctcagtgcttccgtatataaatgaatgcattttcactccatcttttaaaacctacttcctacagatatgtgtggatctcaaagggaattttacaacaccaaagctaaacatgttttaaacaaaagttttacacttcctttgtttttctaatcaccttatcttgaagataggtataaaaagcaatgttcagaattttcaaagccttcaaaaatcagttcccacaattttattgcatgaaaagtatcccattagtaaaagccagcatacacctctttaccataagagagctccttaaaacaccaattgctatttttagttggtaatgttgttctgaacaactctatgaaatgcttgcacttttataagtaaaatgcttgggagtgaaaaatgatgcaagtagttaacactgtgtttgttgtaacttggtgcaggtcagcttagtcccaagggagaaaagctgctcagccaatgacctacattcactccagtgttatataaaatttctattttaggcagttttagtttagtttattctttgagtttgaatttttcacttctatgagcaattcatctgttttcnctgttaaatttttctagaatttcaaaaataaatgtctctacttgttttttattttgtttccagaaattatgaattattgcctttctaaaggttattatgctcaggcagaacaccatcaggagctcataagataaagtgaggtttagattaaaataaatggcaaaaagacttcgagtaatatcgtttttctccattttgcttggaacaggaagagagaagtaaatgattttactttattaaaaacaaaagaaccaaatgttataaatatttgctgaagtttatacattttaatctgcattaaggtaatggttagttggtcaatgctgcctctgcctcagtctgcagcgagaacattgtgttttcatttggtaaatacagttgagcatctacggtgtgccaggtgctgtattaggtgctaaggatgcaggggtgaacaaaacaggcccctgcctccatgcaattctcattctctgggtggcacagttttatgcaagttatcacatgtgaaagaatttatagtttttattatgcaagttttcaaataaatccaattgctgttatcttttgtttttcatggaatatctcgcatctcagaacacagtttgggaatcatattttatttagtgttttcagatgctatctattatatctaagatatttcacatttagccattcgttttataaaaaactccaggcaaactcagctggacttttcttgctttaataacagctttattgagatacaattcacatatcacgaaattctttttaaaaattttacagttcaggccgggcgcggtggctcatgcctataatcccaacactttgggaggctgaggctggcgggtcacctgaggtcaggagttcgagaccagcttggccagcatggcaaaatcccgtctccactaaaaataaaaaaattagccaggcgtggtggcggatgcctataatcccagctacttgggaagctgaggcgggagaattgcttgaatccatgaggtggaggttgcagtgagccaagatcacgccactgcactccagtctcggcgacagagtgagactctgtctcc

SEQ ID NO: 346211 - DNA, 9261 bp, Homo sapiens
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346212 - DNA, 10024 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346213 - DNA, 5082 bp, Homo sapiens
gagttggcgatcgtagaggaaatgtagtccgggaaatcagtgaagcaaaaggtagtgtgtgatgattctaggagcctgaccaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagcaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346214 - DNA, 4724 bp, Homo sapiens
caacagtcccagttacaacagctccagtcacacagctccagttacaacagcccagttacaacagctctagttacaacagctcagttacaacataaccacagaaaagaaaggggagttgaaaaagatacctcccattttagaggagtacattgccattttccatctgccctcgatgctctctggcttggtttgcctgtattttggtaaggtgataaatgttactcttacctttaatctgtaaacattctttagggagcctgtgtgctctagaattgagcccttttgtttttcatgttcgtgtaatttatatttattttgtgcatctcacaagtgactctctctccagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346215 - DNA, 10060 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacagggaccccttccccttccccatttctttatttgttaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346216 - DNA, 9970 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattgggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346217 - DNA, 1814 bp, Homo sapiens
ctgaggatcccatgccaataacctcccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346218 - DNA, 1617 bp, Homo sapiens
tcatagtatcatacgttaggcgccgcggtccctattatgtagttgaacctgggcgtagctgtttcctaggagatcgtgttcatgactagtgcttggctactcgccatttaaaataggctccgtcgatcctggacccgtactgaagacttccgagatccatgttctcgaagccattgacgtgggttctatcactcgtgcgtagattccacgcgagctcgtaaggtatcgaattacggcgcagccccatgtgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346219 - DNA, 6870 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctccccgggatacgggggatactctagagtc

SEQ ID NO: 346220 - DNA, 8461 bp, Homo sapiens
  misc_feature (2275)..(2275): n is a, c, g, or t
  misc_feature (2697)..(2698): n is a, c, g, or t
  misc_feature (6202)..(6202): n is a, c, g, or t
  misc_feature (7391)..(7391): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgaggtaggtattggcaggacagaaacttagaaaatttatactaaaatgcaagctagaagaggtattttatctaacccagagattggctggttgcttagttggtcttctacattgatataagagttgctaggctggatgtgttggctcacncctgtagtcttagcactttcggaggctgaggtggaaggattgcttaagcctaggagtttgagaccacactgggcaacatagcaagaccccatctctacaaattttcttttaaaaattatccaggtgtgatgtgtgccggtagtcctggctgtttgggaggctgaggtggaaggatcacttgagcccaggagtttgagatggcagtgagctgtgatcacataaccacttccgcctggagagcaagaccctgtctcaggggggaataaaaacgagttggcaggtttctttaactcttaggtttaaatagaggagatacttctctgaactttaaaacatttttgagaagagaggcaagcaaattcttactgttttttttatgtaggactttaggcaataataaatgtatcccttttagtttttaatgttttaatttcctaaatttattttctttatttttctaagctaatctgtgtcttagatcagaaatcctttgcgttttccagctctggtctgtatcctgggacaacagttgtagttgtgtttactctgcaggggtccctcgttttgtgatgcacatacttagaggaagttgatttctcctttccttgcctcagtgcttccgtatataaatgaatgcattttcactccatcttttaaaacctacttcctacagatatgtgtggatctcaaagggaattttacaacaccaaagctaaacatgttttaaacaaaagttttacacttcctttgtttttctaatcaccttatcttgaagataggtataaaaagcaatgttcagaattttcaaagccttcaaaaatcagttcccacaattttattgcatgaaaagtatcccattagtaaaagccagcatacacctctttaccataagagagctccttaaaacaccaattgctatttttagttggtaatgttgttctgaacaactctatgaaatgcttgcacttttataagtaaaatgcttgggagtgaaaaatgatgcaagtagttaacactgtgtttgttgtaacttggtgcaggtcagcttagtcccaagggagaaaagctgctcagccaatgacctacattcactccagtgttatataaaatttctattttaggcagttttagtttagtttattctttgagtttgaatttttcacttctatgagcaattcatctgttttcnctgttaaatttttctagaatttcaaaaataaatgtctctacttgttttttattttgtttccagaaattatgaattattgcctttctaaaggttattatgctcaggcagaacaccatcaggagctcataagataaagtgaggtttagattaaaataaatggcaaaaagacttcgagtaatatcgtttttctccattttgcttggaacaggaagagagaagtaaatgattttactttattaaaaacaaaagaaccaaatgttataaatatttgctgaagtttatacattttaatctgcattaaggtaatggttagttggtcaatgctgcctctgcctcagtctgcagcgagaacattgtgttttcatttggtaaatacagttgagcatctacggtgtgccaggtgctgtattaggtgctaaggatgcaggggtgaacaaaacaggcccctgcctccatgcaattctcattctctgggtggcacagttttatgcaagttatcacatgtgaaagaatttatagtttttattatgcaagttttcaaataaatccaattgctgttatcttttgtttttcatggaatatctcgcatctcagaacacagtttgggaatcatattttatttagtgttttcagatgctatctattatatctaagatatttcacatttagccattcgttttataaaaaactccaggcaaactcagctggacttttcttgctttaataacagctttattgagatacaattcacatatcacgaaattctttttaaaaattttacagttcaggccgggcgcggtggctcatgcctataatcccaacactttgggaggctgaggctggcgggtcacctgaggtcaggagttcgagaccagcttggccagcatggcaaaatcccgtctccactaaaaataaaaaaattagccaggcgtggtggcggatgcctataatcccagctacttgggaagctgaggcgggagaattgcttgaatccatgaggtggaggttgcagtgagccaagatcacgccactgcactccagtctcggcgacagagtgagactctgtctcc

SEQ ID NO: 346221 - DNA, 6309 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtgagaagacttgatgtttatggtgcatgt

SEQ ID NO: 346222 - DNA, 3973 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagccaaccgtggactagtgggatcctctagatcacca

SEQ ID NO: 346223 - DNA, 567 bp, Homo sapiens
aagaattaaaagataagaaaagtgtcagttgcagcaaaacatagcctcttccaggagtctcttattaaggggaatgctgcaaatgaaaacatggcttctctgtgagcagatcttgcactactggcagctcaggaacttttgtgctgtgcacatactggtgtcacattgtcctggtcaggctggtgcgcttgtgtgtctttggctggttgctggtgaaagagcacctgcgtgtggtagagccttctgctgtcagagattgtaatctttccattttagtttgttacatcataatgccatgaaatagatcttacatcccttagaaaagaaacccaagcaaataaatctgtacttacttgactgaggctgtcagttttgctggtatcttctctatgtgtgcagcaaagacgatgctggccccgcttacctttctcagtcacctgttgttttctgtgagatgctgccacaaaggggatcactcactgcagtgtgcagagtgaactgatgaaagttcatttttcaagctttaagataaatgctgatcatgtttttgggatttttgtttttcag

SEQ ID NO: 346224 - DNA, 9933 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacacttatatacttgcggatgaaagctataacttttacactttttagaggatt

SEQ ID NO: 346225 - DNA, 5014 bp, Homo sapiens
  misc_feature (799)..(799): n is a, c, g, or t
  misc_feature (825)..(825): n is a, c, g, or t
cctaatgttattcattaacacattttcatattatttaaattcttacaagcaacatttttaatgactgcatattttccatagtcattcctatatctccacttctttactgttataaataaagccataggacacgtttatgtataatcttatttttcacatttcaggtcatttttaacatggattcttagatgctgacaaatattgccaaattccattccaaaagaggttacacttatttcctttcatcagtgaatgagtatgcttattttcactgcacctttgacagctttatagtgtaatgattttttaaaaaattctatatagatgaaaaacaatgcttcggatgtttgggtttcgttttaatgtcactttaactgaagctatcttgtaaaattaaaagattgaaattaaagttatcagagtacattgctgatagttttccattgttttgaagtctgtatcctaaatgattaggtaataattccaaaaaatgccatacacactgtgtaattataaaaagaaatataataaaattttggggccatggtaatacctgtaataaattgagatcttacccctaaagtgggaacatggtagtttctaagtgacagtataacttgaccaacataatcgtacatcttttgaaattgctggtgatagagaattttatgtcagcggaaggaattaggatttaattatattatgtgtggcacagatatattttaaggctgaggttacctctccccattgtggtaaggaattcatgccgtttcctttttcagcttgcttgttagtgtgntagatctcagtttctaggtttttggnttttgttttttttttgtatttgtgtctttagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaagctttgagtg

SEQ ID NO: 346226 - DNA, 8471 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggctggtgacgggagtttggcatctgatacaccacacgcaagtccctgttggctgcacaccatctaccatgctgttcccttcttgggtccatcagctaggaaaagccacatgttctagcaggagttgcgagggtatatttcgtatactgcccttgcaaaatctctcattaaaaatggttaaaccccaggacttggcagagcttacaataaacatttgaataattggaaa

SEQ ID NO: 346227 - DNA, 6032 bp, Homo sapiens
  misc_feature (2275)..(2275): n is a, c, g, or t
  misc_feature (2697)..(2698): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccaggttactgtttgcaagtttattatttacttttgatgttgttatttttgttgttatgaaaataaatacaggcctatgatttttcttaaaaaatggaagtacaggttaattatcccctaaccaaaatactaggaaccagagtgttttggatttccgattttggaatatt

SEQ ID NO: 346228 - DNA, 3833 bp, Homo sapiens
  misc_feature (2275)..(2275): n is a, c, g, or t
  misc_feature (2697)..(2698): n is a, c, g, or t
  misc_feature (3092)..(3092): n is a, c, g, or t
  misc_feature (3094)..(3094): n is a, c, g, or t
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaaggtaagacagctctctgcaccacccacccgtccaccggaagggcatgggctccctccccatctctacctgctaaactttcagattcaaaattgaagtaggcttttctttgtccttcttgactccggatatggaaaatgtttaatggtcaaatgctttgtcctacttataggttagcacacatgtcatttgacacatgggcatataaagaactctttatgccatttaagtacactccaaatatattaatacatttttgccctactgtttgttaattaaagaatatagctttataagactttccatactgctgtcagtgccttctttgtatgttgacntttttgaggaaggctttgcctgcattcaggtgtatgtatcatgtatctagtataatatttatagctcttttgagccacccattctaaaactttacatagatgatctcatttaatcttcactgtaccatattattacgttaattttataactgagaaactagggccatgcagttagtaaatgacacagatggaatttgaaactaggcagtctgtcctgagaacctgtgctcttaagtggaattgatggacccagagacaaaaacatatatcttgacaaagtatgctaatttttatttaatcatgaatataaactgtaaaagcaaatcactatatcggtgaatttttagttgtttttacaaaaagtttaaactttgtaaatgctttaaggcataaatgctcttttttttttttttttttttgtnntttagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataaggtaccatttaacagagagagagtccagcatggtgtgggtttctatctatgtcagtacaacatgtgtgggaagactttggaggcagaacgtttgagatagtcttgcctgattgctctgtccccatattcatgctcttggtactattgtattgaacagcgtattntncctttttatgtcatggctcacctttgtttaaaagtcagccgaacataaatgaagcctcatattttccaggctatagcttgtacagtgcatgttttctctcatatgctaattcttgttggcctatgctccctatttcttttaaaatattattccgaactacccaaaatgtaaaggaaaaaatgtttgtaacagtaggtatacacaatttatcgagcgcttcttatccttactgtgctgagcgctgtacctatatattctctgggttaatatcaactctacccatagactatcagtattaattttactggtttcatcatcataaaaatgagtactggttgtgtctgctgtctttaatttcaaattttcagacattctaaaatatgggccattgaaataggtattcttgagaatcaaggaaataaaacaattataagaggccccttcgccctattcttcatagccgaatacacaaacattattataataaacaccctcaccactacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaacttcctaccactcaccctagcattacttatatgatatgtctccatacccattacaatctccagcatcccccctcaaacct

SEQ ID NO: 346229 - DNA, 1017 bp, Homo sapiens
gctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcaggttgtggaagaaggactctgggaaaatggcctttcctatgaatgtaggacgctgctcttcaaagcgatccacaatctgttagaaaggtgcctaatggataagaacttcgttaggattgggaaatggtttgtccgaccctacgaaaaggatgaaaagccagtcaacaaaagtgagcatttgtcctgtgctttcacattctttctgcatggagaaagtaatgtatgcacaagtgtggagattgcccagcaccagccaatttatttgatcaatgaggagcatatacacatggctcagtcttcacctgcaccatttcaagtactggtaagtccttatggcttaaatgggacgctaacaggccaagcatacaagatgtcagacccagccactcgtaagttgattgaggaatggcagtatttctacccgatggtgctaaaaaagaaagaagaatcgaaagaggaagacgagttgggatatgatgatgatttccctgtggcagttgaagtaattgttggtggtgttcggatggtttacccttcagcatttgttttgatctctcagaatgacatcccggttcctcagagtgttgccagtgctggaggccacattgcagttgggcagcaagggcttggtagtgtgaaggacccaagtaactgtgggatgcctctgacccctcccacctctccagaacaggctatcctaggtgagagtggaggtatgcagagtgctgtaagtgtcctgcctcccacctccccgccgagtttacacctgcagttcctgcct

SEQ ID NO: 346230 - DNA, 277 bp, Homo sapiens
cgcctggctagtttttgtacttttagtagagacggggtttcgccatgttggccaggctggtctcaaactcctgacctcaggtgatctgcccaccttggcctcccaaagtgctgggattacaggcatgagccaccgcgcccggcccacacattacttttaaagtcatgagaaaggacactgaattgcatggacagagtaaggaaccaagccagaccccccgcccaaggacagaggccctggggaccagcactgggctgggcccacccctccagaagcc

SEQ ID NO: 346231 - DNA, 166 bp, Homo sapiens
atggaatccaataatgaagtatagttcatgtgccttcagcctacagattctattcattttcaaagtttttacctagatttgtgtcttagtccattttgtgcttctgtaacagaatacctgaggctgcgtaatttataagtaaaaaagtttcatttggttcacaata

SEQ ID NO: 346232 - DNA, 1997 bp, Homo sapiens
atcatagcactattttattttctgtaactgatgaatgagccttgttttctgcctttgtatttcagaggaaagagataatatcttctacttaatcctggatactatatctgaagtcagagcatccactccaaagcagagaatttctgaaaaacaaaataatgtcatcatatgatgttagaattttttttcaaatgatggttcctaatacttcacattagaagaactcgaatttgatgaccagtttgagaaacaccagtatatccagattacaagaaaaagcgagtcaaaaggatgatcatgaatataacaacttcgaggaaacatttaaccaaagaccaaagctttttaaacaactgagagtttttataagaaaaagacctcatacagtagtccccacttattcatgggggatacatttcaagacccacagagaaggcctgaaatcactgatgtaccaaaccctaaccaggttcttaggatgagctactaaatgacaaatgggtgggtagtacatagagtgtagatacaccagacaaagaaatgattcacagcccaggcaggacagagcagatcacacaagatttcatcacagtactcagaaaaccacaccatttaaaagttatgaattgtttatttctggaattttccatataatatttttgaccacagtttcccatggataactgaaaccatgggaagtggaactgtggataaggcaggactactgtaactatgacatcaatggtaggaacctgaagcataattctgctgtagtggattttttcaaaagaaactcatgaatgaaaaataatttattagatataagaaaggatgcatttgtatctcaaactttacttattctggaaataaatgaaaagccaacacctattacataccgacaaaaatgaaaaaataaataaatgtaaagccatagttcagtactgatggaatctgagaaaatttatatgaccgcgaacccatatctctgtactgaatgtgggaaaggctacacttgtcttgcatccctgacccagcatcagaaaacacatattggagaaaaaccttatgaatgtaaaatatgtggtaagtcctttacccggaacagtaatcttgttcaacatcaaagaatacatactggagagaaaccttatgaatgtaatgaatgtgggaaagcttttagtcagagcactaatcttattcagcatcaaagagtccatactggggagaaaccttatgagtgtaatgaatgtgaaaaaacctttagtcataggtcatcccttagaaatcatgagagaatccatactggagaaaaaccctatccttgtaatgaatgtgggaaagctttcagccatatctctgcccttactcaacatcatagaattcatactggaaagaaaccatatgaatgtactgaatgtggaaaaaccttcagccgcagcacacacctaattgaacatcagggaattcattctgaggaaaaatcctaccagtgtaagcaatgtcggaaagttttttgccacagtacatcactaatccgacatcagagaacccacacaggagagaaaccatatgaatgtaatgaatgtgggaaagctttcagccataccccagccttcattcaacatcaaagaattcatactggagaaaaaccctatgagtgtaatgcatgtggaaaggccttcaatcggagtgcacatcttactgaacaccagagaactcatactggagagaagccctatgtttgtaaagaatgtggaaaaaccttcagtcgaagtacacaccttactgaacatctaaaaattcattcttgtgtgaaaccctatcaatgtaatgaatgtcagaaactgttttgctatagaacatcactaattcgacatcagaggacgcatacaggagagaaaccctaccagtgtaatgaatgtgggaaatccttcagcttaagctcagctctaactaaacataagcgaatacatacaagggagagaccctatcaatgt

SEQ ID NO: 346233 - DNA, 2333 bp, Homo sapiens
ttccttgcggccgcgtgcgcaggcgtacttcctggcttgggaaccacatcgcccgaccgtgctctttatttttcggtggagcagctctgctttctcaggtctctacttacttatataagatggcatcaagaagaaggacctgaccactggcccctgactacatggtctttggaacccgtggcattggaagatgtcagagacatggcacatggatgtgatcttcaaaaactgttacagcctcatctcattggattggtctacacatcaaggtgctggaagtgtcgcatgcccagagatgatgtggaagctctatacccctttcccttctgcccaccttgccctgtgcatctcttcctgaatggcttctcctgaattgtatcctttataataaactggtaaataggaaagagataatatcttctacttaatcctggatactatatctgaagtcagagcatccactccaaagcagagaatttctgaaaaacaaaataatgtcatcatatgatgttagaattttttttcaaatgatggttcctaatacttcacattagaagaactcgaatttgatgaccagtttgagaaacaccagtatatccagattacaagaaaaagcgagtcaaaaggatgatcatgaatataacaacttcgaggaaacatttaaccaaagaccaaagctttttaaacaactgagagtttttataagaaaaagacctcatacagtagtccccacttattcatgggggatacatttcaagacccacagagaaggcctgaaatcactgatgtaccaaaccctaaccaggttcttaggatgagctactaaatgacaaatgggtgggtagtacatagagtgtagatacaccagacaaagaaatgattcacagcccaggcaggacagagcagatcacacaagatttcatcacagtactcagaaaaccacaccatttaaaagttatgaattgtttatttctggaattttccatataatatttttgaccacagtttcccatggataactgaaaccatgggaagtggaactgtggataaggcaggactactgtaactatgacatcaatggtaggaacctgaagcataattctgctgtagtggattttttcaaaagaaactcatgaatgaaaaataatttattagatataagaaaggatgcatttgtatctcaaactttacttattctggaaataaatgaaaagccaacacctattacataccgacaaaaatgaaaaaataaataaatgtaaagccatagttcagtactgatggaatctgagaaaatttatatgaccgcgaacccatatctctgtactgaatgtgggaaaggctacacttgtcttgcatccctgacccagcatcagaaaacacatattggagaaaaaccttatgaatgtaaaatatgtggtaagtcctttacccggaacagtaatcttgttcaacatcaaagaatacatactggagagaaaccttatgaatgtaatgaatgtgggaaagcttttagtcagagcactaatcttattcagcatcaaagagtccatactggggagaaaccttatgagtgtaatgaatgtgaaaaaacctttagtcataggtcatcccttagaaatcatgagagaatccatactggagaaaaaccctatccttgtaatgaatgtgggaaagctttcagccatatctctgcccttactcaacatcatagaattcatactggaaagaaaccatatgaatgtactgaatgtggaaaaaccttcagccgcagcacacacctaattgaacatcagggaattcattctgaggaaaaatcctaccagtgtaagcaatgtcggaaagttttttgccacagtacatcactaatccgacatcagagaacccacacaggagagaaaccatatgaatgtaatgaatgtgggaaagctttcagccataccccagccttcattcaacatcaaagaattcatactggagaaaaaccctatgagtgtaatgcatgtggaaaggccttcaatcggagtgcacatcttactgaacaccagagaactcatactggagagaagccctatgtttgtaaagaatgtggaaaaaccttcagtcgaagtacacaccttactgaacatctaaaaattcattcttgtgtgaaaccctatcaatgtaatgaatgtcagaaactgttttgctatagaacatcactaattcgacatcagaggacgcatacaggagagaaaccctaccagtgtaatgaatgtgggaaatccttcagcttaagctcagctctaactaaacataagcgaatacatacaagggagagaccctatcaatgt

SEQ ID NO: 346234 - DNA, 579 bp, Homo sapiens
ttccttgcggccgcgtgcgcaggcgtacttcctggcttgggaaccacatcgcccgaccgtgctctttatttttcggtggagcagctctgctttctcaggtctctacttacttatataagatggcatcaagaagaaggacctgaccactggcccctgactacatggtctttggaacccgtggcattggaagatgtcagagacatggcacatggatgtgatcttcaaaaactgttacagcctcatctcattggattggtctacacatcaaggtgctggaagtgtcgcatgcccagagatgatgtggaagctctatacccctttcccttctgcccaccttgccctgtgcatctcttcctgaatggcttctcctgaattgtatcctttataataaactggtaaatgtaagtaaagtgttttcctgagttctgtgagccattctagcaaattattgaaccagagaaagaggggttataggaaccctcaacttgtagccagttggtcagaagtatgggaggaccagcttgtgattatcatctgaagtggaggcagtcttgtgggactgagccctttaacttgagg

SEQ ID NO: 346235 - DNA, 493 bp, Homo sapiens
  misc_feature (13)..(13): n is a, c, g, or t
  misc_feature (20)..(20): n is a, c, g, or t
  misc_feature (57)..(57): n is a, c, g, or t
tgataactgcccnattcccntccccccttatcattgcgtttcgcgtctccgggtccntacccattgtcagatgactcttgccatgttgtgctggctggactcgaactcctggattcaagcaatcctcctgcggactcagatgatccttctgcctcagcttcctgagtagctggggtaaagcttaaagtaaaaacatatccccagcagaatcataacttttcacagaggcatctaatttcttaaccttaaagcagaagagaaacgtctttcaaattttcctatgacggtcaaggagtgggggttgtggaatgtatatacttagatgaattaaactcagaccttctccggttggatgtttgagccgcccagacaaagatgaagattaacacagtttaaggatgaaatatagaccatcctgtgcaaaaccaccgtgttgcagtttaattaaaagaattcattaaagtggtgccccatccagggtaattagtatgcg

SEQ ID NO: 346236 - DNA, 796 bp, Homo sapiens
agcggaaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgccgggactccgcagccgagctcggccgcccgcaggacgctccaggagcgtcgcggaccgggcggcacgggacgctgcggggctgacctcaagagccgaggttcgcgccgagtccaaccggacccggacgctgcgcgcggagtgcgcgtcgagtgcgcgccgagagagaagcggcgcgcagcggcgtcctcccggatgcggacgcgcaacttgaagcaactttaagcagagaatgtggatttaaatgggataaagcaacaaagtcgacttagggtcagaaagcccatcggaaccttccacttcctttgcaagcagagataactggctacagtcagcctccccaggacctgatgccaatggataactgcaagatcagaaggagatgactcttgccatgttgtgctggctggactcgaactcctggattcaagcaatcctcctgcggactcagatgatccttctgcctcagcttcctgagtagctggggtaaagcttaaagtaaaaacaataacatcattattgccaaaacctaagattggatgcaagatatttttggacctttgcattctgcctaccaactgactccacccagacc

SEQ ID NO: 346237 - DNA, 1006 bp, Homo sapiens
agcggaaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgccgggactccgcagccgagctcggccgcccgcaggacgctccaggagcgtcgcggaccgggcggcacgggacgctgcggggctgacctcaagagccgaggttcgcgccgagtccaaccggacccggacgctgcgcgcggagtgcgcgtcgagtgcgcgccgagagagaagcggcgcgcagcggcgtcctcccggatgcggacgcgcaacttgaagcaactttaagcagagaatgtggatttaaatgggataaagcaacaaagtcgacttagggtcagaaagcccatcggaaccttccacttcctttgcaagcagagataactggctacagtcagcctccccaggacctgatgccaatggataactgcaagatcagaaggagatgactcttgccatgttgtgctggctggactcgaactcctggattcaagcaatcctcctgcggactcagatgatccttctgcctcagcttcctgagtagctggggtaaagcttaaagtaaaaacatatccccagcagaatcataacttttcacagaggcatctaatttcttaaccttaaagcagaagagaaacgtctttcaaattttcctatgacggtcaaggagtgggggttgtggaatgtatatacttagatgaattaaactcagaccttctccggttggatgtttgagccgcccagacaaagatgaagattaacacagtttaaggatgaaatatagaccatcctgtgcaaaaccaccgtgttgcagtttaattaaaagaattcattaaagtggtgccccatccagggtaattagtatgcg

SEQ ID NO: 346238 - DNA, 654 bp, Homo sapiens
gggttgggcaggcagccgcaggccccatcctcggcggcccctgaggcgctggcggttgcagccccgggggtccgttccgaacctcgactcctagtggtgccggcgcccaggccgcctctcagcggcggcagcgtgaagcccggcggcgagggcggaggtggcggccctgcgggcggcgagctggcggccaacatgttccccatggtcgctggcggtggcacctgctcccggcctggtctccgctcccacccggtgcgccacgcgcaaccgaactcgctgccgccgccgccacccccgtcgccagcatggtgtatcttttggacatgtccattttggaagaaacttttgtgttaaaataaactaatatattatgggctagaacataaaattcaccaagaatttcaagataaaaatactaatgttttgcttgtttgggttatttcaaacaataactttgtctataattttttcaccaccgaccctctacctccttgcatgctcattctcctgtgtggctagatgcatttcgggtgttttgaatattatttcagagcgtatcattccagaaaataagtttaaagtttgaaatgtttattttttgtaacccatgaatcttcagcttaagtatcttctgacataaaagcattttcataa

SEQ ID NO: 346239 - DNA, 333 bp, Homo sapiens
tcctgcctgatccaagtgcatcaggtctgagactgttctttgttccacgcttctatctgccagaagaatctttttaggtaaggaggctatcataggaggcaatggagcttctagctgttgtccaaggaatgaaagcaggcgcctccagctgagccacttcccatgaacataattcctgtaatcagtcaaaacactccatgggcctcttcaagggaagattccaaactcattccaaaagcaacttccattactccaaagagcgaaagagagaaggttcttatggtcagctgtagattcaacttcattatcacgttacagtggctgtccagattg

SEQ ID NO: 346240 - DNA, 319 bp, Homo sapiens
acataaacacacacacacagatcagtaatcacaggaaatatttatggttggctgctcgaagaggcccacacctgttaagccacagcactttgagattacttgagacaaggagtttgagaccaccatgggcaacatgcaagactctgtctctacaaaaaaaaaaaaaattttaaatagtctatggcggtgcatgtctgtagtcccagctacacagcaagctgaggcaggaggactacttgagcccaggagttggaccttacagtgagccatgatcatgccactgcacttcagcctgggcaacacagtaagaccctgtctc

SEQ ID NO: 346241 - DNA, 646 bp, Homo sapiens
ctcccccagcctggctgccgccttgcagtttgatctcagactgctgtgctagcaatcagcgagactccgtgggcgtaggaccctccgagccagctccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaagaagtacacaata

SEQ ID NO: 346242 - DNA, 601 bp, Homo sapiens
ccggtccgaaaagctcaatattcgggtgggagtgacccgattttccagctccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaagaagtacacaata

SEQ ID NO: 346243 - DNA, 609 bp, Homo sapiens
gtgcagaaatcacccgtcttctgcgtcgctcacgctgggagctgtagaccggagctctccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaagaagtacacaata

SEQ ID NO: 346244 - DNA, 159 bp, Homo sapiens
aaagggttatgttcagctaggcctctttgttgttctgggcaatccacttacaggtctgtgcctctctttccttaccaagtaagggctgccttggaacgtgcaaggatgtggtgagcagtaactaagatgagcagagggctgggggatatttggttgaaa

SEQ ID NO: 346245 - DNA, 807 bp, Homo sapiens
  misc_feature (728)..(728): n is a, c, g, or t
  misc_feature (730)..(730): n is a, c, g, or t
  misc_feature (733)..(733): n is a, c, g, or t
  misc_feature (735)..(735): n is a, c, g, or t
  misc_feature (738)..(738): n is a, c, g, or t
  misc_feature (741)..(741): n is a, c, g, or t
  misc_feature (745)..(745): n is a, c, g, or t
  misc_feature (764)..(764): n is a, c, g, or t
  misc_feature (766)..(766): n is a, c, g, or t
  misc_feature (771)..(771): n is a, c, g, or t
ggacgacctaagtcgcgtcacgctaccggcgcgtcacgcgaccttgccgcaatgctcctcccgcgcagctcttatccccgtagactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagagtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggactggatggaggacctgaagacatgaggtggaggcacaggtagaagagaagattctcaccatcgctgattcacacaaaagcatttntncangnggntgngatnaatgattcccaagtggtanancgaantgtgtcctgggtattatacggggtccttatcctcac

SEQ ID NO: 346246 - DNA, 1082 bp, Homo sapiens
ggacgacctaagtcgcgtcacgctaccggcgcgtcacgcgaccttgccgcaatgctcctcccgcgcagctcttatccccgtagactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagaggtaccggcgaccgctgtcggaggcgcggactcggggcagggccaggagtcgcccggaagcccggcggtgggaatgggtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggactggatggaggacctgaagacatgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcaggtcatgtcctccaggtttctgcacgttgctgcagatgacatgatttcatgaatttct

SEQ ID NO: 346247 - DNA, 740 bp, Homo sapiens
ggacgacctaagtcgcgtcacgctaccggcgcgtcacgcgaccttgccgcaatgctcctcccgcgcagctcttatccccgtagactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagaggtaccggcgaccgctgtcggaggcgcggactcggggcagggccaggagtcgcccggaagcccggcggtgggaatggggactggatggaggacctgaagacatgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcaggtcatgtcctccaggtttctgcacgttgctgcagatgacatgatttcatgaatttct

SEQ ID NO: 346248 - DNA, 949 bp, Homo sapiens
ggacgacctaagtcgcgtcacgctaccggcgcgtcacgcgaccttgccgcaatgctcctcccgcgcagctcttatccccgtagactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagagtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggactgctgtggtctctgcttctatacacgacaccccccacctacatcgatgacgtcaccgtcaccaccggcgtgaagcgagacagtggtgagggcttctggactggatggaggacctgaagacatgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcaggtcatgtcctccaggtttctgcacgttgctgcagatgacatgatttcatgaatttct

SEQ ID NO: 346249 - DNA, 539 bp, Homo sapiens
ctgagattgtgccattgaactccagcatgggggacagagcaagactccatcccaaaaaacataaataaataaatgtgacattcagaatagtaaatagtggaaatggaaataattattagtaaaaaattagtagttcataataaacaagacatgcaaagcactttttaaatatactaatgtacaatgaaagaaggtatttcaataaacacctggcaaagaatattaaaactaaatacagaaagatacttcctcatgttcatttgaaaaaaaaaaatactaactcccatttgaattgatttacagtttataaaatgctttgacatttagctatctcatttaggggaggttttagagcttaattttacagggcatgaagctcagatgaggtttccttagcgaaatacagacccagcccctggacttctatttattactgatctttaagctttatcagcccaatagtcaccaagagagctgctctgtatgttttttaaaaatcacagaaagtacaaaataaaggtgatattaaacgactgtct

SEQ ID NO: 346250 - DNA, 227 bp, Homo sapiens
ggcattgcacgtgatggggtgtgagagggatctcagagatgactacggtttttggcctaagcagctaggtgttggagttgtcattttcgctggtggggaaggctgaagggcaggcatttcttgaggggatgggaattaattggaatcaagattcaaatgtaggtgcttgttagacatctaagtggaagtgttgtggaggcggttgaatacctgaggttcggggaaag

SEQ ID NO: 346251 - DNA, 569 bp, Homo sapiens
tctgtatctttgaaattcaaagtatacgtggaaaccaaaataagattatatcaagaggccaggtgcagtggcgcatgcctgtaatctcagcactttgagcggctgaggcaggcagattgcttgagctcaggagttcaagacctgggctacatggcaaaaatgtttctacaaaaaaaatacaggcagggatcacgcctgtaatcccagcacattgggaagtggaggttgggggggatcagctgaggtcacgggttcgagaccagcctggctaacttggtgaacccctgtctctactaaaaatacaaaaattagctgggcgtggtggagcgtgcctgtaatcccagctacttgagaggctgaggcagaattgcttgaacataggaggtggaggttgcagtgagctgagattgtgccactgtactccagactgggcaacaaagtgagactctgtctccaaaaaataaaaaataaggccgggcgcagtagctcacgcctgtaatcccagcactttgggaggctgaggccagcggatcatctgaggtcaggagttcaagaccagtctggccaac

SEQ ID NO: 346252 - DNA, 385 bp, Homo sapiens
ctgcccagcatctgaacccacttgctagattcgggacatctcccattatctaggtcttggtgggaagtaggctctgacctctaactttagaagcctaagggatgagattcaccctctactaactcccctgacagccttgtgacccagatttagccactatgtactttgtgtcttgagtaagcaatgccaagatgaagggatgataagtgatattggatctgtggtagctctagtattagcagtttggcattgaggctgtgtttattgtgagtagtggctgcctacagtggccattatgtcaaatactagagatgtcctatgttggtggtggcagcagcatctccaccagactgttcctgccactcctactcccttggtcccagcc

SEQ ID NO: 346253 - DNA, 631 bp, Homo sapiens
ttgtttgtttgttttttgagatgaagttttgttctgtcacccaggctggagtgcagtggcacgatctcggctcactgcaacctctgcctcctgggttcaagcgattctttcacctcagcctcctgagtagctgggattataggcacacgccaccatgcccagttaattttttgtatttttagtagagacggggtttcactatgttggccaggctggtctcgaactcctgacctcaagtgatctgcccactttggcctctcaaagtgctgggattacagggaccatgcccggccacaacaggcactttagaatgcaggctcagtaaccaactttatgaagggagaaacagaggcatgaacagttgaaactatttccttaaagacagccagttccatcttgccatacagagtgcccacattttcagataatccgaagaggcatcacttagtgtccccagggaaatgaaaaacaaaaaacaaaaaacaaaaaaacctgtaaatagtctggtcatcttctcctaactatcatcttggaccagattgcatctggagtactagtttattaggcatacccgagactgggtaatttataaagaaagaggtttaatggactcacagttccacatgattgg

SEQ ID NO: 346254 - DNA, 402 bp, Homo sapiens
cgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccggtgggtgggaccgggatagacgggaagtgggggcttggaggggactgaacaaccctagaccccgacaagggggagggagcccacaaggtcttctaaatatcaagagtcccagcccacccctgcctcagccaagctcagcttctgggactcccagagagcacctgctggggaaggacaaagaagggggctgttaccggccctcgggggcttcagcaggggagccgggtcccatcggtgcggccg

SEQ ID NO: 346255 - DNA, 848 bp, Homo sapiens
cgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaaggtgagtggcagcccgaggagggc

SEQ ID NO: 346256 - DNA, 951 bp, Homo sapiens
cgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccgatcttccctgacgggcagtactttcacctgcggcaccggggcgtggtccagcagtccctgaccccgcactggggccaccgcctgcacctgaagaaaaaccccaagctgtgtgctttctgtggctcagacccgcccgggccccaagtctatacagcaagaggaggcaggaagacccagatacggaaatcatggcgcctgccagggcctggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaaggtgagtggcagcccgaggagggc

SEQ ID NO: 346257 - DNA, 485 bp, Homo sapiens
gaatgcctgacccgcccgcccgcctttggttttcctgcggcacatcctcgcctggctccatcaggttcaagttcaggtttgacccagccccctcaagcctctgcccttcgtggactgaggatgcacccagtctccaccatcagccttctccccgggaagtcggtgtactctgctctcctctgcctctatttgttctccctccatgtgcccccggagactatcatcttatttaaccaccatctatcggtggacaacttaaaactctgccttcagccaagagctccctctgcggctccagcccatcttccccccaatagtctgagggatctttctaaaattccatctgagggacactctttctcgttgtacttcctagtggtgactgtcccttgaccctatgctttgacatgagacctgtggaaaaaaattctacaactatttggtatgttggagggaagcatgaataaatgaagtcagattgtgct

SEQ ID NO: 346258 - DNA, 90 bp, Homo sapiens
ttcattatcagtccaaacatcttaatttatggttagaaacttttcacagtgtgcctgtttcacactatgtaattttccagaatgctttcc

SEQ ID NO: 346259 - DNA, 1629 bp, Homo sapiens
ctaaatgctccacttaaaagatacagaactgcagaatggataagaactcaccaaccaactatctgctgccttcaggagactcacctaacacataaggactcacataaacttaaaggggtagaaaaaggcatttcatgcaaatggacaccaaaagcgagtagagcaacggtagctattctcatatcagacaaaacaaatcgtaaagcaacagcagttaaaagagacaaagaggggccgggcgtggtggctcatgcctgtaatctcagcactttggatcacaaggtcaggagttcgtgaccagtgtggccaacacagtgaaaccccgtctctactaaaaatacaaaaaaaaaaaaaaaaaaaaaaaaaattagaggggtgtggtggtaggtgcctgtagtcccagctacttgggaggctgaggcaggcgaatcacttaaatctgggaggtggaggttgcagtgagctgagattgcaccactgcactctagcctgtgtgacacagcaagactctttctcaaaaaaataaaaaaaagagagagacaaagagggacattatagaatggtaaaaggccttgtccaacagtaaaatatcacagtcttaaacatatatgcacctaaaactggagcttccaaatttacaaaacaattaaaataggcctaagaaatgtggtagacagcaacacaataatagtggcagatttcaatattccaccgacagcaccagacaggttagcaagacagaaagtcagcaaagaaacaatggatttaaactataccttggaacaaatggacctaacagatatatacagaacatttcatccaataaccgcagaatacacattctattcaacatcatatggaactttctccaagatcgaccatatgataggccataaaacaagcctcaataaatttaagaaaattgaaattgtatcaagcactctctcagaccacaacagaataaaactggaaatcatctccaaaaggaactttcaaaaccatgcaaacacatggaaattgttaaataacctgcttctgaatgagcattgggtaaaaaacaaaatcaagatggaaattaaaaaattcttctaactgaatgacaataatgacaaaacctatcaaaacctctgggatatagctaaggcagtgctaagaggaaagttcatagccctaaacacctacatcaaaaagtctgaaagagcacaaacggacaatctaaggtcacacctcaaggaactagagaaatagaaacaaactgaacccaaacccagtagaagaaaggaaataaccaagatcagagcagaaataaataaaattgatagaccattagcaagattaaccaagaaaggaagagagaaaacccaaataacgtcactgagaaatgcaacaggaggtattacaactgacaccactaaaatacaaaagatcattcaaggctactatgaacacctttacgcacataaactaaaaaacctagttgagatggataaattcctggaaaaatacaatcctcctagcttaaatcaggaagcattagataccctgaacagaccaatacaagcagtgagattgaaatggtaattaaaaaattaccaacaaaaaaaagtccaggaccataaggattcacag

SEQ ID NO: 346260 - DNA, 185 bp, Homo sapiens
aacatggaggggtaagctaggctgcaccctgaaatcacacagacacacagccctcaagccacaaatatcctcttacacaactgctgcctataaaggagcagagatacaactgcaacaggggtcatttgttaccctattggtaacaaatttcttttttacttaattgttttggtacttgccagcat

SEQ ID NO: 346261 - DNA, 1632 bp, Homo sapiens
taaatagaaggtgagtttatttctccagtcttgaaattaacaattttcaagaaaacaaattattagaataactaggggactacacaggtggagaacagtgctttcagacatgtgaagcgctcttcgagaaaatgagccctctctgggagaatggttcaggataggcattgacctcaagagcttctaaggtggcacccaacacttagaaagaaatagggcccgtgaacattgtggtgctgagtcttggcgcccttctgtgccttcaccaacccggttgcacaaccaagaacaacctttgtttaacaccttagtgtggaatgcctcatagaactgtggatcatagaacccaggttggaacttctcaggaaatcttcagttcacaccttcttatttgacgaagaaacaacgaagaaaaacgtgagttttgccccatagactttcagagttccctgtgggtgtggtggacgcactctcccccgcaaatatatcatatacatcagagagcttccttataaaagcgttggtgtgtgggcacccattttattttccaacgtcccccgaagaggcccattaagagagacacctactttgcgcagtgactccacataattgtggccatgcccattgtgcggccaccaaacttccgttgtgtgtccctccctgtgggagaagaaggcagaaagaaaggccacagagaaggtggaacaacccaagtaaataggaacaagttcacttcatcattagggagactccaacggggagaaccccaatgagaataagtctccttacatcagttgggagcaccataaatacgtggcaacgttcactcgagagggagatcctacatcctgagcacatagtcgatagcactaccggagtcttgtggaacccccaacagactgttgcgtatttgaacagccacgatcaagatggactatttaatatgcacgaccttgttcacaagtcggtaaatctatctcttcaccgtggtataggcctcacccaaaaaggggcctaaattacagcttagcatataattttagaccatgtggcgaggcaccacggacgttggtggaagtttggcaccaaggtattccattaaacaaagggggcataggccacacacctatatttcgtaccaccctctgagattccacggtgtatttgcccttttacccgcatttgggaagcatataattgatgaagacgtaagcaaaacaatcatgtttctcgtggtagactccacagcgaggagatgtaattattcaatacgaaaactagccagcacgtcacaaacaatcgtgtcctatatcacactacaaacgtgtgatagaataataaccacacgcactttattatttatagagacacaacaatacaacaacagcaccatcatacattatctctatagcatagccactactactagcacccactaaagctcaataataactacctatcaagacagcactgccacaatttagatccgaaacacaatcactactcactaatacagctcgcagtacatattagcaggagaacctaaccaacaacacaatataatcagcagcatcaaccaccaccaaatctactgtcgttaacctactatactgtaactatatatatgaccaa

SEQ ID NO: 346262 - DNA, 883 bp, Homo sapiens
  misc_feature (640)..(640): n is a, c, g, or t
  misc_feature (699)..(699): n is a, c, g, or t
  misc_feature (708)..(708): n is a, c, g, or t
  misc_feature (727)..(728): n is a, c, g, or t
  misc_feature (731)..(731): n is a, c, g, or t
  misc_feature (744)..(744): n is a, c, g, or t
tgggccccaggctcccggaagtgctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacatgcggccgaatttggggttaattgggccaattggccttatggggggcggttttccaattaattggccgcgggtttaacaacgtcnggactggaaaaacctgggggttacccaactaaatggcttggaagaaaatccccttttgncaagttggngaaataggaaaaaggcccnnacngatggcctttccnaacagtggccaacctgattggcaaagggaatttggaggcgtaaaaattgggtaaaatatcggggtaaaattttggtaaagggattagcccggaattggttaaatggttgttcaatttggaacaagagttcctttttaaa

SEQ ID NO: 346263 - DNA, 840 bp, Homo sapiens
  misc_feature (493)..(493): n is a, c, g, or t
  misc_feature (495)..(497): n is a, c, g, or t
  misc_feature (500)..(500): n is a, c, g, or t
  misc_feature (504)..(504): n is a, c, g, or t
ttcgctacctaaggtagcgaaggtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanannnaanaaanaaaaaaaaaaaaaaaaaaaaaaatttgggccccctttgccccaatgtattttaaatttggaacagttttttttgggggcccgaaattgggttcatttgggaattttcccttttagggggtgttttaaaaataaaagggggcggtttattaaaactgtggtctgtgaaaaaccctggggtctcccaatttaaacccttttgaaaaaaatcccctttttccccgtgtgggaaaacacaaagggccccccccggaggcctttttcaaaaggtgtgcacctctttatgggcgaagggaaaattgtgcgcgcgtaaattttttgtaacccgggattttttt

SEQ ID NO: 346264 - DNA, 928 bp, Homo sapiens
  misc_feature (78)..(78): n is a, c, g, or t
  misc_feature (581)..(581): n is a, c, g, or t
  misc_feature (583)..(585): n is a, c, g, or t
  misc_feature (588)..(588): n is a, c, g, or t
  misc_feature (592)..(592): n is a, c, g, or t
taagttgtttctatgaaacaaacatatttagttcactattatatagtgggttatattaaaaaaaaaaaaaaaaataangtccgaattggcacgaggtttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanannnaanaaanaaaaaaaaaaaaaaaaaaaaaaatttgggccccctttgccccaatgtattttaaatttggaacagttttttttgggggcccgaaattgggttcatttgggaattttcccttttagggggtgttttaaaaataaaagggggcggtttattaaaactgtggtctgtgaaaaaccctggggtctcccaatttaaacccttttgaaaaaaatcccctttttccccgtgtgggaaaacacaaagggccccccccggaggcctttttcaaaaggtgtgcacctctttatgggcgaagggaaaattgtgcgcgcgtaaattttttgtaacccgggattttttt

SEQ ID NO: 346265 - DNA, 650 bp, Homo sapiens
tgggccccaggctcccggaagtgctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtaaaaaaaaaaaaaaaaaaaaaaaaaaaaaaaaaaaaaaaaaaaaaaaaaaaaaacctgcattcagaatcctcaacccaggttatattgtttgagccatgcttatttttggagtggcccttgaggctaatccgggaatcaatcctagtatagcgggtgtttttgggacttttgttgggactcttactctttgcacctgcgggacgggtctcc

SEQ ID NO: 346266 - DNA, 1084 bp, Homo sapiens
  misc_feature (737)..(737): n is a, c, g, or t
  misc_feature (739)..(741): n is a, c, g, or t
  misc_feature (744)..(744): n is a, c, g, or t
  misc_feature (748)..(748): n is a, c, g, or t
tgggccccaggctcccggaagtgctgcccggcgctccggaagcgattcatcgggccgcgagcgccctccccgtcgttttccgtgagagacgtagagctgagcgacccagcccgcgagcgaggtgaggtaggcgccgggcgacgcggggccggaacgcgaagagggtggtggagtcgggctacccactgattttccttcccttacttcccctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanannnaanaaanaaaaaaaaaaaaaaaaaaaaaaatttgggccccctttgccccaatgtattttaaatttggaacagttttttttgggggcccgaaattgggttcatttgggaattttcccttttagggggtgttttaaaaataaaagggggcggtttattaaaactgtggtctgtgaaaaaccctggggtctcccaatttaaacccttttgaaaaaaatcccctttttccccgtgtgggaaaacacaaagggccccccccggaggcctttttcaaaaggtgtgcacctctttatgggcgaagggaaaattgtgcgcgcgtaaattttttgtaacccgggattttttt

SEQ ID NO: 346267 - DNA, 793 bp, Homo sapiens
caccagtcaaaaaagctggtttctctatgtattttacactgcatctgctgcctcccacaaactgaaggcagttaatacgacatccaccagaaaaataccctggagacccagatggatctttttccttctcattacccaccccaggtagtaagatataatatccagtaagtggaaaatcagatgtaggggttgctagactagtgttagcaaaaaattggaaaggagcagttaatactctttctgatatttttgttaccaaatagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaattttggggcggcccgggccccaaaaaatttttaaacccttctttgggggggggggccccggggatccggcgaagacaatggggccataacgcgggtccccaaaagagagaacccggcggccgacgaaatacagtgcgctgggagtttccccccacatataaaaaaacgccccggggggaaacgcagcgccggtcgcgagaaaaccccagaaggggagcccggaggggcaatcagcgggcgctcctccacaccggaggccccacgcggacgcagatataaaataaccgccgg

SEQ ID NO: 346268 - DNA, 877 bp, Homo sapiens
  misc_feature (634)..(634): n is a, c, g, or t
  misc_feature (693)..(693): n is a, c, g, or t
  misc_feature (702)..(702): n is a, c, g, or t
  misc_feature (721)..(722): n is a, c, g, or t
  misc_feature (725)..(725): n is a, c, g, or t
  misc_feature (738)..(738): n is a, c, g, or t
caccagtcaaaaaagctggtttctctatgtattttacactgcatctgctgcctcccacaaactgaaggcagttaatacgacatccaccagaaaaataccctggagacccagatggatctttttccttctcattacccaccccaggtagtaagatataatatccagtaagtggaaaatcagatgtaggggttgctagactagtgttagcaaaaaattggaaaggagcagttaatactctttctgatatttttgttaccaaatagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaacccatgtcggccgcttgggccaagtcaactttaaattcgggcaggttattcatgcggccgaatttggggttaattgggccaattggccttatggggggcggttttccaattaattggccgcgggtttaacaacgtcnggactggaaaaacctgggggttacccaactaaatggcttggaagaaaatccccttttgncaagttggngaaataggaaaaaggcccnnacngatggcctttccnaacagtggccaacctgattggcaaagggaatttggaggcgtaaaaattgggtaaaatatcggggtaaaattttggtaaagggattagcccggaattggttaaatggttgttcaatttggaacaagagttcctttttaaa

SEQ ID NO: 346269 - DNA, 961 bp, Homo sapiens
tgggccccaggctcccggaagtgctgcccggcgctccggaagcgattcatcgggccgcgagcgccctccccgtcgttttccgtgagagacgtagagctgagcgacccagcccgcgagcgaggtgaggtaggcgccgggcgacgcggggccggaacgcgaagagggtggtggagtcgggctacccactgattttccttcccttacttcccctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgttagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaattttggggcggcccgggccccaaaaaatttttaaacccttctttgggggggggggccccggggatccggcgaagacaatggggccataacgcgggtccccaaaagagagaacccggcggccgacgaaatacagtgcgctgggagtttccccccacatataaaaaaacgccccggggggaaacgcagcgccggtcgcgagaaaaccccagaaggggagcccggaggggcaatcagcgggcgctcctccacaccggaggccccacgcggacgcagatataaaataaccgccgg

SEQ ID NO: 346270 - DNA, 616 bp, Homo sapiens
  misc_feature (269)..(269): n is a, c, g, or t
  misc_feature (271)..(273): n is a, c, g, or t
  misc_feature (276)..(276): n is a, c, g, or t
  misc_feature (280)..(280): n is a, c, g, or t
taaatagaaggtgagtttatttctccagtcttgaaattaacaattttcaagaaaacaaattattagaataactggtggagtcacagacatatttctagctccattaggtcaaaggaaaggaaagaggacaagggtagaaaggagacaagccctctaagaaactgtccattcagtctgtgactccaccagttattctaactaatttgttttcttgaaaattgttaactttcaagactggagaaataaactcaccttctatttaaaaaaanannnaanaaanaaaaaaaaaaaaaaaaaaaaaaatttgggccccctttgccccaatgtattttaaatttggaacagttttttttgggggcccgaaattgggttcatttgggaattttcccttttagggggtgttttaaaaataaaagggggcggtttattaaaactgtggtctgtgaaaaaccctggggtctcccaatttaaacccttttgaaaaaaatcccctttttccccgtgtgggaaaacacaaagggccccccccggaggcctttttcaaaaggtgtgcacctctttatgggcgaagggaaaattgtgcgcgcgtaaattttttgtaacccgggattttttt

SEQ ID NO: 346271 - DNA, 1069 bp, Homo sapiens
  misc_feature (78)..(78): n is a, c, g, or t
taagttgtttctatgaaacaaacatatttagttcactattatatagtgggttatattaaaaaaaaaaaaaaaaataangtccgaattggcacgaggtttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtaaaaaaaaaaaaaaaaaaaaaaaaaaaaaaaaaaaaaaaaaaaaaaaaaaaaaagaacaagagaggggggcgcgcgcgccatagaagaatatcccccgcgcgagggggggcgccccaagtttagcagcgcgcggacccgcagttatttgagaccgaagggtggccgcccaatagaaaggaggcagccacatataaaagacgctaggacgcgatgggcgccgcagcattacaacacagagcgcgcgagagacacggggggacaaacaacagcatgacaaagctaggggagaacacacgttgggggaaagagaagcaccccaacaactcgacagggagggggggggagagcaccaacaatgggggggcccaacaactttcacgcctcaaaggagggacatatattgaagacgcgcctccttgagagggggcaccatatagtacgacacactgttaagagagcggcgatctactcagtgctgtggtttccaaacaacaatcgccccgctaataaatggtacttgcagctcgtgcgtgggaaagagcattttgcggcgagacaacacggaggatcgatagtttcgagaagacaattttttttcccccgggaggt

SEQ ID NO: 346272 - DNA, 908 bp, Homo sapiens
  misc_feature (561)..(561): n is a, c, g, or t
  misc_feature (563)..(565): n is a, c, g, or t
  misc_feature (568)..(568): n is a, c, g, or t
  misc_feature (572)..(572): n is a, c, g, or t
tgggccccaggctcccggaagtgctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanannnaanaaanaaaaaaaaaaaaaaaaaaaaaaatttgggccccctttgccccaatgtattttaaatttggaacagttttttttgggggcccgaaattgggttcatttgggaattttcccttttagggggtgttttaaaaataaaagggggcggtttattaaaactgtggtctgtgaaaaaccctggggtctcccaatttaaacccttttgaaaaaaatcccctttttccccgtgtgggaaaacacaaagggccccccccggaggcctttttcaaaaggtgtgcacctctttatgggcgaagggaaaattgtgcgcgcgtaaattttttgtaacccgggattttttt

SEQ ID NO: 346273 - DNA, 764 bp, Homo sapiens
tgggccccaggctcccggaagtgctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaaaaaaaaaaaaaaaaaaaaaaaaattttggggcggcccgggccccaaaaaatttttaaacccttctttgggggggggggccccggggatccggcgaagacaatggggccataacgcgggtccccaaaagagagaacccggcggccgacgaaatacagtgcgctgggagtttccccccacatataaaaaaacgccccggggggaaacgcagcgccggtcgcgagaaaaccccagaaggggagcccggaggggcaatcagcgggcgctcctccacaccggaggccccacgcggacgcagatataaaataaccgccgg

SEQ ID NO: 346274 - DNA, 855 bp, Homo sapiens
  misc_feature (612)..(612): n is a, c, g, or t
  misc_feature (671)..(671): n is a, c, g, or t
  misc_feature (680)..(680): n is a, c, g, or t
  misc_feature (699)..(700): n is a, c, g, or t
  misc_feature (703)..(703): n is a, c, g, or t
  misc_feature (716)..(716): n is a, c, g, or t
tgggccccaggctcccggaagtgctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtaaaaaaaaaaaaaaaaaaaaaaaaaaaaaaaaaaaaaaaaaaaaaaaaaaaaaaaaaaaaaaaaaaaaaaaaaaaaaaaaaaaaaacatgcggccgaatttggggttaattgggccaattggccttatggggggcggttttccaattaattggccgcgggtttaacaacgtcnggactggaaaaacctgggggttacccaactaaatggcttggaagaaaatccccttttgncaagttggngaaataggaaaaaggcccnnacngatggcctttccnaacagtggccaacctgattggcaaagggaatttggaggcgtaaaaattgggtaaaatatcggggtaaaattttggtaaagggattagcccggaattggttaaatggttgttcaatttggaacaagagttcctttttaaa

SEQ ID NO: 346275 - DNA, 875 bp, Homo sapiens
  misc_feature (78)..(78): n is a, c, g, or t
  misc_feature (632)..(632): n is a, c, g, or t
  misc_feature (691)..(691): n is a, c, g, or t
  misc_feature (700)..(700): n is a, c, g, or t
  misc_feature (719)..(720): n is a, c, g, or t
  misc_feature (723)..(723): n is a, c, g, or t
  misc_feature (736)..(736): n is a, c, g, or t
taagttgtttctatgaaacaaacatatttagttcactattatatagtgggttatattaaaaaaaaaaaaaaaaataangtccgaattggcacgaggtttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtaaaaaaaaaaaaaaaaaaaaaaaaaaaaaaaaaaaaaaaaaaaaaaaaaaaaaaaaaaaaaaaaaaaaaaaaaaaaaaaaaaaaaacatgcggccgaatttggggttaattgggccaattggccttatggggggcggttttccaattaattggccgcgggtttaacaacgtcnggactggaaaaacctgggggttacccaactaaatggcttggaagaaaatccccttttgncaagttggngaaataggaaaaaggcccnnacngatggcctttccnaacagtggccaacctgattggcaaagggaatttggaggcgtaaaaattgggtaaaatatcggggtaaaattttggtaaagggattagcccggaattggttaaatggttgttcaatttggaacaagagttcctttttaaa

SEQ ID NO: 346276 - DNA, 1053 bp, Homo sapiens
tgggccccaggctcccggaagtgctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaaaaaaaaaaaaaaaaaaaaaaaaaaaatttttgggcggttggcctggaaaatttttaaaaccatggtttgggggcggggccacaggaggtagcggtgacagtggctctaaagcctggtaccaaggaagcaaccgggcgacagggcatagtcgggctgggaattctccccaataaaaaacgccccggggggaaccaccgagggtttcggacacaaacatacaagagggagttcccgggcggaccaaaaggggattctacaacaacggagttcccagggacgctggaatataaaattaaaggcccgccggggaagagagagtgagaggaagaaagaaaacaaagaagaagaaaaagcaaggaggacgacacggagcagaggggagaaagcagacagagatcacagaaagggcaacaaaagaaggcaaaaggagggacgggaggcggagggaggagaagagaagaagctgagacgcgaaaagagaagcagccgcacaacggagaagaaggaaggagagaaggagaagagaagagcagagggagaaggaaaacgaagagaggaagcaggcagaggtaagcgacaacagaagaaggacgaaaacaggaagagaaaaagcagaagaacgaagcaaaaagc

SEQ ID NO: 346277 - DNA, 468 bp, Homo sapiens
aacaaatccggagatgcggtcagggaagagaagcgctccaccaacttagcagccaacacccctgggaagggggggcgcctgagatttgccagcccctcgggccctcaggtctctgcagcccctctgtgccctgatgacccagtcaccttcacccggccaggatgcatcgccgccttaggttcccacctgctgtggcagcacctctcgtgctgctcaactctggcttgtctggaatgtctccctcacacctctcaaccttccagaaactggctaaatggaggctcgcttagcaagtgaatgtctaagcccactgaatccctagaaccagaagccaagttctttacaaatctttcatgggtattaggttggtctttaaaaagaatgttatgaaccagccaaaaatgtgtgtgtggtgtttaatccctgacaggccagttgagaggtatgtatgtcggacaagagttgctg

SEQ ID NO: 346278 - DNA, 97 bp, Homo sapiens
acacacacacactcttaattacccagggcaattacttactcttcccactagatagctcttggagagactggcctaaaacacacacacacacacgcgc

SEQ ID NO: 346279 - DNA, 438 bp, Homo sapiens
catgttagcaaataagtatatagtgtggaaaggtctgtagtcaatagcagtcattttgacaataggaaaaggaatgtgtgaaacttctgggtctgtgtgtgtgttggggttggtgggtcaagggaggggatccaaagatggtttcactaagaagggaaaaacaccggacctgagacttgaatgcaagtagaattttgccaggcagatgatctgttcttccaggtagataatccatcctgggcagacaaaaccaggctgtagaaggaacaccatgtgtggagcaatagaaatatctcattgttactggagtataatgcatgcaagaagcaggcaaggtagacaggggccaccgtgaaggaaactctgaataggggaatgatatcatcacatttccatgttaggacaaataggagaagtttaatatcaagatgtaagaaa

SEQ ID NO: 346280 - DNA, 868 bp, Homo sapiens
gatggttcttgtagcagcaaagtttcagtaatgcttcggacacaggatgaacactgagttgccactatcaacaggattgccctaggaatctcctgaagctcatcaccagagccagacccgaatgaacactgtcctggttctttggtcttctgggcagtcagcctcccgtttttttcctttggagcttcctgaatacccatctcctgggaattgtggaaacagctggctaagcccatgaggctcaccctgtagagccatttatttgaatggatcaaatcctattccatgggaagggcctccagccagtgcaattccaaatcccaatgagtccctaagagaggtgcagggcccttacctctgtaagagacccctctgagatgccattagagcctatccttaatgaatagtattagaagcctccaagctagagcagtcaggtgggggcactgagaaattctggacattggaacagacattatctccagccaaaaatttgagtcagcatcatagatgtctccagccctttgttttgaacctgtttgtaccatgtcagggccaacctcctggcctcgaggtagcaatcactactctttcccaggctgaatcttttataattaatcattaatgattcacggcatgccatgcactagcttctttttgtttttttttgtttgtttgtttgtttttagacggagttttgctcttgttgcccaggctagagtacaatggcactatctcagctcactgcaacctcctcccgggttcaggcaattctcctgcctcagcactttgggaggccaagacaggaggatcactcgagcccaggaatttgagaccagcctgggcaacatagtgagaccctgtctct

SEQ ID NO: 346281 - DNA, 628 bp, Homo sapiens
tttagagaggctgctcacggcagtgcctctgagcaggtagcactggagccgatcctctgctgcgatgaggtggcaagccaagaacatcatgagggagggaagggcagtcccagaagagagagcacagtgcaggtgccaggtggggaccacgggacactggaactgccttggtgtgtttatttccaaatagtgtctggcattacactgagatgaggagacttttttgtttttcattttttgtttttttttcccggggtaggggtgcatattggatttcttcaggagattcagcctcttgaaaaatatgaaatatagacaagtatatatacataaagatatatttgagtattttaaactttatatagccaagtatcttaaactctgcacacttgaatttttaatcctcgtgtatatccattatgattatttctattagttccagtttgaggttggtgatgatattgtcatagaagctttgtcaggcttcacattgtagcagctggtcttgaaggtggggcatatccttgttcaatgtgactactttagttgcctgtccaatatgaagtagaaaagcagatttctggattacagtatttgtcaacatagaatttgccgatttaaaaaaaaa

SEQ ID NO: 346282 - DNA, 500 bp, Homo sapiens
atcattcatccttaagctatatttttatcaaaatgaaaagtactaggaaggaatggcccttttgaagttacatattttgtaaaagcagatcatcattacttaggatttttttggcttcacctgaaacatgaaagcaaatattgattagacatgaggaagttcagaactagaagcaagtttggattatgaaggaaaattatggctccacagattttatctgttactgaaatgagtttacatggggaactcatatttctggttcactgaggccttgacagccaatttatttggatgcctttccatggaagtacgttgcatgggaattcagctgtgtagatgagaggggaaaactaaccactcagccacaccatagcaagcatactcatctctgggagatttaaaaaactgaatcgcaaactcattatattgtatacattaatatgtgcagtttttgtatatcaatgatacttaataaagctgtttaaaaaaaaaaaacaaca

SEQ ID NO: 346283 - DNA, 1192 bp, Homo sapiens
gacccgcgtggccggcggaaaggagcagcgggagccgcggccgtagggaagccacgggaagacgggcggctgcgctgcgatgcgcggccctctccctgaagccctcggctcaggcgccacaggaaaggctccttcgggcaggcctcagctttcagcttaagtttttttcctttggccgagtcaactgcggtgccgagttgtattttcctttcagaggtgtgtccgagaaccattcttaggagacgcctgccggccgctttgggatagggcctgtctgcccatgctggcttccaaaggcctctgtgtgttcctgtatgtgggcgtgcacgtacctgtcacatgtgtacgcgcagaccacaggatgtccacactggcttccaaacacatctctgtgtttctgtctgtgagtgtgtacgcaggtgtcaaatgtgtacgcacagatcacagggtgtccacactggcttccaaacacgtctctgggttcctttatgtgcgtgtgtatgcacttgtcatgtgtacacacagatcacagggcatccacactggcttccaaacatgtctctgtgtttctgtctgtgggtatgtacacacatatcacatgtggaagaggtaggaagaggctggaacaggtaagggtcatgaaggtgcagtgcactattgtactgtttgcgctttatatgtgtttggttagttttgcaagaacatgctggtgaaggagagagaaccccaaacaattgattagcagtgctactgaaactcagatatacacaggaatggcaaagaaacatctatgaaaaaaagcagattctggaactccatctccctgagattgtcactcatggggtctgcaggaagtttcaggaatctgcattttcttctaataaacgtggtccacaggttataagttgagatacaaatagaatatataaagtaaaaaaggaaaatttgaagtttcctgcctagcccaactcttctcattggtagtgtctgttaaattggaaacatatctctttccagacatattaataccttttatacagttgactcttgaacaacattagtttgaactgcgtgagtacacttatatgtggatttttttcagtaaatggaatatttttggcgatggcaacaattttgtgaaaaacctcacagatgagtcgcttagccaagaaatatggaaaaaaaaagaaaa

SEQ ID NO: 346284 - DNA, 381 bp, Homo sapiens
tgcagaacggcagaaacaacgggggctctagaaacctcatttttggaagttggtatcgttaatggcattatatcagaggaagaataaaggaatccattgtgaactaatgtgaaggaatggaggtaatgattagatcgcacaggtaggttgataacaacttaacctctgatggtttcccatccttatctcttttgtttagttaaattttttttaaaaaaatcaaagttcttcctctaatgctgaatccctctggcttccaaatctagagcaccaagaaactttgccagtgactttgggatgcccacaccttgctgattttgtgtgggtaccacttcctgcttatgtttgatttcataaatgtgtccacttttcagctcaaaa

SEQ ID NO: 346285 - DNA, 598 bp, Homo sapiens
gtcatattgctctccccaagaccaggccccaaattcccctaatatgaaacacaaaggctgtcagtcctcagagctctccaagctcctgcagaggcttaagccatggatgtggcatggtgtgcagcaagaacacgggaatccgcccacaaaccccgcgctgggtcctgccactccctagctgcaagaccttgggccaatcatgcaacttcacagggcctcagcgtttcaccatcaacaaaggaaagctctgggcctggccaaatgacttctaagattattaagagggtcaaatgagcacatatgagaacagcgccaattgaaaacacaaataaacgtcggtattttccagctgcccagggccttaggctccagaatttctcgatgttctgctcaggaggcactgtcctatcttggtaattatgaaggcatattcatacgttcttttactgccaggtgcggtggctcacgtctgtaatcccaacactttgggacaccaaggcgggtggatcacctgaggtcaggagttccagaccagcctggccaacacagtaaaaccctgtctctactaaacacacacacacacacacacacacacacg

SEQ ID NO: 346286 - DNA, 764 bp, Homo sapiens
tccaccccttcactttcagtctacctgtgtctttagaggtgaaatgggtttcttgaaggtagcatatagttggtttttgcttctttatccattcagccactcatgttttctagctggagaagtgagaacatttacattcagtgttattattgataagtaaggacttactactgctattttgttgcttgttttctggttgttttgagacttgtctcttcctttcttactgtcttccttatcttgtagtatgttttaatttgttgctttttacttgtagtggatctattataaaaactgctgtggttaccatgaagcttacaaaaatgtttttatagatatgagttatttaaaagagatgacaacttatcttagatcccaaataatagaaacaaacaaagccaaaaaaacccccacaagttttacagtttaattcctacccccacgttttaacttttagttgtctcaatttatactttttttttttttgcgatggagtttcactccattttgagatggagtgccgtggtgcaatcgcagcttactgcaacctctgcctcccgggttaaagcaattcttctgcatcagcctcctgagtagctgggattacagttgcctgcaaccacatgcatctaatttttgtacttttagtagagatggggttttgccatgttggccgggctggtctcaaacttgtgacttcaggtgatccacaagcctcaacctcccaagctgcttggattacaggcatgaaccaatgctccagc

SEQ ID NO: 346287 - DNA, 600 bp, Homo sapiens
tgtcgacgaagccgtagaacccgagcctcggagacgtggcctagtactgttctattaatgatagtgctctgtgatgacaggaatatgcactctccttggcaggcatactttatgggttggttggagaacaggaggtttgcagggggaggtgactgtccgaaggacagaatggtacgaggctttcttcactgcgtagcttgtgtgttcagttctgtatcagggcttattctacggagtatggactttatcgggaaaatttgtttttaacttttaagttcaagagtacatgtgcagatttgttatataggtaaacatgtgttatgggggtttgttgtagagattatttcatcacccaggtactaagcttagtacccattagttatttttcataatcttctccctcctcccaccctccaccctgcgaaaggccccagtgtgtgttgttcccttctatgtgtccatgtgttctcatcatttagcttccacttataagtgagaacaagtagtatttggtttttctgttcctacgttagttttccaaggatggtagcctcctgcttcatccatgtccctgcgaggacatagtttcgttctttttta

SEQ ID NO: 346288 - DNA, 309 bp, Homo sapiens
ggggatgtcctaggcagagtcccccactccaatgaggctataaaaatcatcatttgcaagtctccagaacaagactctggaccctcatgcctagcagtttaacaccaacaaaaggatccattcttcaacatcttctttgatgtgaactattctcagggagctaagatggacagaggtgtgctccttccttcacctcagctctttctggctctatggccctgggcaagttacccagcctctctaaacttagagttctctctctctctctccctctttttttctttctttttttttttttttttttttttt

SEQ ID NO: 346289 - DNA, 419 bp, Homo sapiens
tggagtaaggaggccaaaagttaatgaggagagcatcccagagagaagaaatggtagagccagtggtgtgaaggcaaaagccagtaggacgtatgcagagaagtccatgcagttcagtggtgccagaatgcaaaatgagaagcaaggagtggtaagagacagcaggaaagcttagcttactttttaagtcagccatgctgagcagcttgggcttcaacttgacaatgatgaacacatatttggcaagatttggcagaggacaggttggatatgaagtttagaaaaatccctacagctggtgtggatttgaatggaattggacagaagaccagcccaagttaggaagctgatggagagtcccagcaaaatacaggaatctgagcaattttatagttttataaatataggaacatgaatga

SEQ ID NO: 346290 - DNA, 895 bp, Homo sapiens
ggctagacgtatcagaacttgaactcctgacctcaggtgatctgcccgactcggcctcccaaagtgctgggattacaggccaccgcgcctggcctacaaagggataatttaaaataccactatagtgttagggaaagcctcttttaatcctggcacttccccatccatttccttaagagagatatttccaataaagttgcttttttttttatgttatcagggtatattttttggccaaccatatgctggtaataattatacatttaaaagaatgagataatcagttttactttaaaatgttactgtgatgttctagaaattcaccctttgcaattatttaatcttatggtgatattttttaaatgtcatcttaatgggtaaagggtatgcaattttaaaaagcacttttggtggtttgcgagcaaaaaaaaaaggttgaaataccaccatgttaatttgttcagcagcaaaagaaaaagaaaagagaaagaaatactgccgtatcactatagtaagctgtttgctagaaatgggattgctagatcaaggggtatgaatgatcagctttacaaaataatgtcagattactttctgaaggggttgtatcagtttgtactttggccagcagttttgtctgtttatatactttgatcaacagtgtgtaagagttacagttgatctacaacctctccaacacttgttattgtcagacttaatatttgccaatggaatgggtatgaaatgatgcatcattgtggttttaatttgcattttttgttattaatgagattgagcatcttttgtatgtttatgaactgtctttgtttcctttttatgaaatatctagtcatatattttaccctttgttctgatgagttgtcttttaaaactggta

SEQ ID NO: 346291 - DNA, 492 bp, Homo sapiens
ctgcacgaggggttctcatcatcatttgaccactcaagttcagctaccttggtcatacaacccgttaaatctatccccagccctaccagttattttgtatattatgtcactttttatttttatttatgtatatattttttgagactgggcaacagaccgagactctgtctcaaaaaaaaaaaaaaaaaaaattgatagcatgaaaatttgaagtaaagagtcaattatgttaaagaaaaaaacactccaaaatctaacatgatgctaggctacgttaacaagagcctggcattaaaaactgagtcaccatattcagcattaataagatactagcaaagctctcattcagctgccatgcctaggttgtgcttctgcatgttcagaggatgtggaaagcaattgaaatgattaaaagcatggaaaatcacatctctgaagagcgatgaaagtaggctatttaactaaaagaaaagaagattgaaggaagaaaat

SEQ ID NO: 346292 - DNA, 521 bp, Homo sapiens
aaactgctgatgctgacctgtgcctcaagaggcttgcctgtttgggggagaagcctgatgtggagaccattggaagaggctaaggcaagctacctgttccttaaacagattgttcaacctattccagtttttggtcctctacctcacacattccttccacttccaaatcctgttgttagaggatgttacctgccaaatttgtactttggaatcctcctctgcatgttcataagtttttgggttttcctttctgctcacttgccaatcctctatctactttcaatcttctaaaaattgctgaaacttcttgtctcactgttaattctttaacatcaatttgttggtattttaggataaaatataagtaagtgtatatcttcaaccagctatcattaaatggaaaatttctggtattattttatactttcatctattttcctgtagacatttaaacaagaagtctctgtgtgtatgtgcacatattcaatgttttaactacaaaatataaatttcttcttgta

SEQ ID NO: 346293 - DNA, 669 bp, Homo sapiens
caaacttctggagaaattaccaaattgctaacatgccatgtgaaatccttgaacactattaagataattacaggagattgatgtgtttgccttagtttaaaatcttaattagcattgacaccaaaagcaacatccctatgttaaaaacacaatgtgaatactattttattattaccatggaaccttgacctttctttccttcacctatagctcaatccttgtcttcctccagtcccagggctccttatcacaaccatcattttgattttacactggatttacatgataccttttactgaagtgcttaaatctaggaaagaataaatttctattgactaggagtcagaaacttagggtagaatgatggagcattgttttataacaggagcagtttccagcttggattcaaaatactgattaaaaaaatttgttttctattatgattggatctgtactttctaacgccaaatattttaatccagatactttttatcttgatcccacgcttgccctttaacctttaccagaaattcagagaaacagagtacatatttcgccacacaatggtcatcctcactgaatacttttatccagaggtctacaaactatgaccctccagtcaaatcctaccttgcccttgtttttgtaaataaagttttattggaacat

SEQ ID NO: 346294 - DNA, 586 bp, Homo sapiens
agtgactggtccaaggggtggacacatgacccactccaggccggtatggatccttcattgggatttctacatggatgctggggtgaaaagctctgactttctcctggagctgctaaactgagaatatattaatctagggctgatggcagccatttttgtaccacatggagagagccggtctgcagaaggagctaatagagaccagcagagatttcagatagacagactgcctacaaagcacaatatagagtccaaactttcctcctgcagctcttcattccatcctcctagcttacattagttagtttgtgctaaagttagtttgtgttgggtttcccataatttgaaatcaggaagtcctaactagtatggtgcccctttttcttctcaaccttgtgaattcccagtgccattctgcctctcaaagcttacttccctagaagggcctgatcttggtattgcacaaaggtgtgaatgtgaggcagtgtcttcctgctccctgaggtggcatgggtcctggagattaatatgcaacagcttagcaggtgggatccgggttcatccagccataccactcacacagaaa

SEQ ID NO: 346295 - DNA, 335 bp, Homo sapiens
ttactgtgtatgtgtgtgaatcccttgcttaaaaatatttcatccattggttaggttgtggagaaactggaacacttacgcattgctcgtagtaatataaaatggtatagctgctctcgggtgtggatggcaagatggctgaataggaaccactctggtctacagctcccagtgagattaatgaagaaggcgggtgatttctgcatttccagctgaggtacccagcttatctcattgggactggttagacagtgggtgcagcccacggagggcaagccgaagcagggtggggcgttccctcaccaggaatagcaaggggtcagggaactccctcc

SEQ ID NO: 346296 - DNA, 407 bp, Homo sapiens
gcctcaaaaaaagaaaaaaaaatgttttggtaacacatcagttctgtaaaaccaggtgattactaacaaacttctcatcctgatgtagagcaggaatctgcagactaagaaggctgtgttccggaggctacctagacacactatacacatgatagccaggggcatctggacagaggacgggaccgagagctgagcttagcaaggccacagagggtagagtgtacattctttgcatgcctgcccaggtccgcttcccaggtttgttcttgttggcattgtttactggttcagcagcaacacaaatgaactatctcatagaccccatcgcttgcctctgaatgttaacgttttgtttgttttttgagacgaagtcttgctttatcacccaggctggagtgcagtgggca

SEQ ID NO: 346297 - DNA, 557 bp, Homo sapiens
gggtagcagaatcttggtaacccctgaatgatcaggaatctaatcggtaaaaacatgtgactttggccccttgatatataaagtgtctaaaagcattacaacaggactcacaaagctcctaagtttcacttttgcaaacaaggtatctgtgactcccgcttgtggtgttttaaatttacctttattccatagccctgagtttctgtgagtccaggacatctcctcaatacaaagtagccactgtgttcctatgtgttgcaaccaggagtcagtacagacttcattcacctcaaagttgcaagcgctcgatgcagtcacaatgtccatcaccagtgctcatgcactgcctgtttttaggaagtatccacatctaagtggtgtgtatatttcttaggaacacttagtatttttaaaacctgattaacataaaaacaattagtttttaagcagacccacttaaggtattaaaggccaactgcaagtaacaccctgcgaggctctgtagatggatctattgaaataccattaaaaaaagtgttcaaacctaaaaaaaaagc

SEQ ID NO: 346298 - DNA, 700 bp, Homo sapiens
tagatacagctagtaaatgctgtatatttagtgcagatagtaaaatagcagtaaaattataataatgggactgaacacacaatccctgctttgtcagagcttatcatctcttacaggagacagacatcaagcaggtgattacaaataaatgtaacattacaattctggtaagtgttgtgaagaaggacaggtatttggtgataggaatatcattgagaaataattgcagtcatttaggggaaaacgtagaagagtaccattagttgaggtttttgaaaacacctttattgatacgtaattcccatatcatacagtttactcatttaaagtatacaattcagtggtttttactatgttcacagatgtgtataattgttcgacaggtggttttagaacattttcatcagaaagaacctgtagcctttagctattcctcttgtccttccatttgccttcctcttctgccctgtgttgatttgtttttaaacaaattattgtgtacatagtcaaacaaaaaattagtttgactaattttgagtgttaataagcgccacttctctgttgctaattccttctcattcctaggtcacttcctggagagaataatttttaattttatttggtttaggtcatgccacagtaatgagatgccactattcttaaaatttgtactaatatgtattttagtggaaaagaaaaa

SEQ ID NO: 346299 - DNA, 702 bp, Homo sapiens
  misc_feature (225)..(225): n is a, c, g, or t
atgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaanaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtagaaagttcctttggccaactgcttagaagcccaacacaaccca

SEQ ID NO: 346300 - DNA, 184 bp, Homo sapiens
atgtccgagactgcgcctgccgcgcccgctgctccggcccctgccgagaagactcccgtgaagaagaaggcccgcaagtctgcaggtgcggccaagccccaaggcagccaagccaaagaaggcggcagccaagaaaaagtagaaagttcctttggccaactgcttagaagcccaacacaaccca

SEQ ID NO: 346301 - DNA, 393 bp, Homo sapiens
cttcttttagctctcccagaactctccacattgatcccactctggctactagcaccagctggacagtaacgactttcagaggtgaacacaatgtgcttcaacatgccttcctgaaagttcagttagcaactggacagcatctgaattccagttctgcaaagctcttctctgaatacctgaggtaccagcatgatcctggcactgcccctgcctccgctgtcttgtctaattctagctctctggggccactcttgtgagtttctaggttccgagaaccttaatcttttccattgtttcccagccctagacaggtagctgctacctgatgttgtcatcctgtgttagctcagtgttcatttttaccattaaaacacctgctttaaataatcttca

SEQ ID NO: 346302 - DNA, 608 bp, Homo sapiens
gctaggtgaaatagagaagttgccagaggacttctgggaaaaaacatttgaaaaggaaggactgaaaagagaagaaatgggcacaacggggactccgggtctggccataacagccaggagaaacaagggcttaagccaggaggtctgaaaagagaacagaaggtagaccacctagaatggggacaaggcacttccactctgcaaaggtgagtgtgtttgcagtgcaaagcaagaaacgtgaactttaaaattcttcaggcacatgtgttcaaaaggcaaagatacatgagaatgcaagatgaaaaactccagcgcaagatcaggctttttaaactgccacagctcccctgtctccccagctagcttctattcgccttcccaggctcctaagcccagtgacaggagagactctggaatgatcagagattctggaatgaaaagagctatgcccactgcttaggaggccaaggattctgcaaactgatccccgcagataccacagcgctttactctggtctccaaggccatggcacaccctaaaagattaaaatgccttaaggtaaatgaccattcccagatgaaggcacagaatgtaaacaaagtgtggg

SEQ ID NO: 346303 - DNA, 554 bp, Homo sapiens
gctaggtgaaatagagaagttgccagaggacttctgggaaaaaacatttgaaaaggaaggactgaaaagagaagaaatgggcacaacggggactccgggtctggccataacagccaggagaaacaagggcttaagccaggaggtctgaaaagagaacagaaggtagaccacctagaatggggacaaggcacttccactctgcaaaggtgagtgtgtttgcagtgcaaagcaagaaacgtgaactttaaaattcttcaggcacatgtgttcaaaagtaaactgccacagctcccctgtctccccagctagcttctattcgccttcccaggctcctaagcccagtgacaggagagactctggaatgatcagagattctggaatgaaaagagctatgcccactgcttaggaggccaaggattctgcaaactgatccccgcagataccacagcgctttactctggtctccaaggccatggcacaccctaaaagattaaaatgccttaaggtaaatgaccattcccagatgaaggcacagaatgtaaacaaagtgtggg

SEQ ID NO: 346304 - DNA, 260 bp, Homo sapiens
cttggcgtcccaaagtgctaggattacaggtgtgagccactacatccagccttgagtagacatttggatcaaaggcctatagttacaagagtggctgggctggagatacaaacttgtgtactatcatcatattattaatcctacattataggtgaggttatataattttctcagagtcatgcagtgctggagtctctcctgtaccttatataatatctctctctctctctgtctgtctttctgtctctgtctctctcata

SEQ ID NO: 346305 - DNA, 3205 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346306 - DNA, 3071 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346307 - DNA, 2942 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctacctcttgacagctggtggaggggagttggggagctggactggatgactctgaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346308 - DNA, 2977 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346309 - DNA, 1500 bp, Homo sapiens
tggacagctggacagtgcagaggaggtggacagcacagaggaggctggacagcacagaggcggtggacagcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346310 - DNA, 256 bp, Homo sapiens
tgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccga

SEQ ID NO: 346311 - DNA, 266 bp, Homo sapiens
cagaaaagaaagaaaaaaaaagggggctacttggtgctcccctgctactctgcctctcacctctgctgttcatactctaccatctctccctacgcctttccgcccaccactttgccatgccctcgactctgttctctccccagttttcatgctgcccatccaggtccaggccccgccccctgaggactcagactctggctcggactcagactatgagcactatgacttcagcgcccagcctcctgtggccctgaccaccttctaca

SEQ ID NO: 346312 - DNA, 3080 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346313 - DNA, 3259 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgattttagttatggtctggcaactctaggggggaccctgtacctaatcctcccttt

SEQ ID NO: 346314 - DNA, 3004 bp, Homo sapiens
cagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatga

SEQ ID NO: 346315 - DNA, 444 bp, Homo sapiens
ttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaccccagcagcagtggcgtggtccagcaatgaccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtc

SEQ ID NO: 346316 - DNA, 973 bp, Homo sapiens
tgtgcatgtgtgtgtgcgtgcatccatccattggttattgtagcccacttttgtggttagctgatactgcttatagctttcagatgctttgacatttgctgtttcctcacagaattttgtgtagatcttagcacactgagcactgttgtggttcaggacacagttggtttattggcttttagggtcagatatacagctggctgtttggactctaactgtcaaaatgctaaatattgggcgcctactcccagatccttctcctgggtgttcagaaagctgtaatgagcactggggacttaagaaaccatgtagacatgcagcacctctttcaaagccattgcccaaaaagcttgaggggatttctgtggctaaaacttgtattgactgctgaaataaggaaataatgaaatgcaaattctgttttactgaagcctagttttagttattttaggttatgactataaaacaacattacaaagggttgatagtcttgtacatttctgcagtgtggtctatggttgccatgtttctgtttatgaactactggggctaacgtttttggtgagaaccagaatgatctatactcacagtttgacttctgtcagttttttgtaacctctaggcattttattagttctttcacttttggtttcttttgttaggtaagagcatacaggctgggcgcagtggctcatgcctgtaatcccagcactttggaaggctaaggtgggtggatcacaaagtcaggagtttgagaccatcctgaccaacatggtgaaaccccatctctactaaaaatacaaaaattagccaggtgtggtggtgcatgcctgtaatcgcagctacaggaggctgaggcaggagaatcgcttgaacccgggaggcggaggttgcagtgagccgagatcacaccactgcactccagcctagacgacagagcgagactccttctcaaaaaaaaaaaaaaaaaaaa

SEQ ID NO: 346317 - DNA, 243 bp, Homo sapiens
gagattgcgccactgccctccagcctgggcgacagagcaagactctgtctccaaaaaaaaaaaattggaaatttaacaaaaatatataaatgtgaagagatatttctgtggttccttttttggaaggtaccccttcaattaagtttcatagttattctgcctctgacctagctttcttgattttttggattcttgaatgaggtaaagcagacttgggaagttgttagacacttaataagtaat

SEQ ID NO: 346318 - DNA, 233 bp, Homo sapiens
ggaatgagttgttgctgttggtagctcacttttccctcctgaaatttttagtgaatttctaagatgaaggaataagcaagagtaatcaatttaaaatctaccaattgagtcctctttggtgattgtcaaccactgaagtggcatgtgaggaaactgatgggtcctgctttgtctcaccaccagtcatttaaatagcgaaagtaccattgaggtgaatagaaagtgcatagtta

SEQ ID NO: 346319 - DNA, 302 bp, Homo sapiens
agttgtcatgttttccttagtctccttcaatttccacacactgaacatgacattttaccctttactagttcagtatatcccaaaaataaggataagaaacaagttatcacaccaaaaaaattaaaaacaattctctatattgtctacttcctagtcctttttgttcttaaggtatcatttatggctattttttccatcaaggttgcaatcaaatttcatacattgcatttagttattgattctctttagttagctttattctagaactgcactatgcagtatggtagcactagtccacctgg

SEQ ID NO: 346320 - DNA, 2233 bp, Homo sapiens
cgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaac

SEQ ID NO: 346321 - DNA, 2261 bp, Homo sapiens
cgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgggcgccggggaccgggcccggccaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaac

SEQ ID NO: 346322 - DNA, 171 bp, Homo sapiens
ctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggtgaattccaagtcgcacatctttgaa

SEQ ID NO: 346323 - DNA, 375 bp, Homo sapiens
gcagggaaggagcggcccctccctggcagtgctgtgtcctctgatggcgtgcagcacttcagagttactctgttaggcagcatggctctccctttgcatgggagtgagtgtcccacaaccagcactgtctctgcctgcgcctttcctcccagccccatggccgtgtgctgagtgcaccggccctgttctgcctttggactgaggaggcgtgttcctcttcctatgtctccctgactgtaggagcgatctctctttgagtcggcatggaagaaggagaaggacatcgtttccaaggagatagagaagctccgcacgtccatccagaccctgtgcaagagcgcacttcccctggggaagatcatggactacatccag

SEQ ID NO: 346324 - DNA, 2340 bp, Homo sapiens
cgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagagaagtacaagcagagatcgaaaacagaaggaagaattgaaagaagaccgcaagccaagagaaaaggacaaggacaaggagaaggccaaggagaatggcggaaacagacacagagaaggggagagagagagagccaaagcccgggccaggccagacaacgagcgacagaaagacagaggcaacagggagcgggacagagactccgagcgcaagaaggagacagagagaaagagtgagggggggaaagagaaggagagactgagagacagggaccgagagcgcgaccgggacaaagggaaggacagggacagacggagagtgaaaaacggggagcactcctgggacctggacagggagaagaacagagagcatgacaaacctgagaaaaagtcagcaagctcaggggagatgtctaaaaagttatcagatggaacttttaaagactccaaggctgaaacagagactgagatttccactagagcttccaagtcattgacaacaaaaacatcaaaacggcgatccaaaaattcagtggaaggtgactccaccagtgatgcagaaggagatgctggacctgctggccaagataagtctgaggtgccagagactccagaaattcctaatgagctttcatccaacatcagaagaattcctcggcctgggagtgcaagaccagcccctccccgggtcaaacggcaagacagcatggaggcgctacaaatggataggtcagggagtggtaaaaccgtttcaaatgtgattacagagtcacacaattctgacaatgaagaggatgatcaatttgtggtggaagctgcccctcagctctctgaaatgtcagaaattgaaatggtaacagcagtggaactagaagaagaggagaagcatggtggacttgtgaaaaaaattttggagacgaagaaagattatgagaaattgcagcagtcacccaaacctggggagaaggagcgatctctctttgagtcggcatggaagaaggagaaggacatcgtttccaaggagatagagaagctccgcacgtccatccagaccctgtgcaagagcgcacttcccctggggaagatcatggactacatccaggaagacgtggatgccatgcagaatgagctgcagatgtggcacagcgagaacaggcagcacgccgaggccctgcagcaggagcagaggatcacagactgtgccgtggagcccttaaaggctgagctcgcggagctggagcagctgatcaaagaccagcaagacaagatctgtgctgtgaaggccaacatcctcaagaatgaagaaaaaatccagaaaatggtatatagtatcaatttgacttcgagaaggtgaacactcaaaagtttcagagatgaaaagtcacctcagtttaaaagcaaaaaggaagatagaaaatcattactcttttaagttccagtttgctaagaaaatgaacagtttacaatgttattatccagctaattttcagagctttaaaactgtaagcatgttaagtgtattaaaaaaaccatgttttcttacctccttccagatggaatactggctagttataaatagcgcttccaaacacctctgtgaaaagtttttttgaaagcctgttctttgtgtttctgctgtaacctgtttagttctgtaccagaactctctagcaggtaagtggtgtgggcataccaag

SEQ ID NO: 346325 - DNA, 735 bp, Homo sapiens
cgcgtcctggcaggaccgggcggcggcggcggcggggccggcggcggccagggacccgggcttaggctcggccaggccggctgaggggcgcgggcggccagcgggcggcggacgccgtcatgaacgcggcggtggtgaggcggacgcaggaggcgctggggaaagtgattcggaggccgccgctgaccgagaagctgctgagcaagcccccgttccgctacctgcacgacatcatcacggaggtgggcgccggggaccgggcccggccaggtgattagaatgactggtttcatgaagggcctctacacagacgccgagatgaagtctgataatgtgaaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaagctctctagtgacgatgcggtgcggagggttttagctggagagaagggagaagtgaaaggccgggcctcactgacctcaagatctcaggaattggataataagaatgtgcgagaagaagagtccagagttcacaaaaatacagaggatagaggagacgctgaaataaaagagacggtggaagatacatctatcctatagaggaacgaggatcagaaagctggattttgaagcaag

SEQ ID NO: 346326 - DNA, 368 bp, Homo sapiens
ggtaatagaaaaaaaaggaatatgatacatggaaaagtgatcaaatctgaccctaggcttataaaacaaatagaagcaattatatgaataatacttgatgatttttacttgagaggaattgcatctcagatatgtcagcaatgggagaagagagaaagcagattcaatgaataaatgaagtgaggtcaaaacaagagaggcaactcaaaaacaccaggaacctatcttctttttttttttaaaggttctttttttcttttttttttttttttttattattctcatggcaacccggcctctcagcgtctcctctaaactcgccctgcgagcatgtaggctgggcccgggccgtcacaacacaaggccgg

SEQ ID NO: 346327 - DNA, 391 bp, Homo sapiens
ctcctgatataatgaacctagaagagcatggcatcatttctgcagtattcttgccaaaaatacataagccacatctaattccaaggaaacataagaaaaattcaaagcgaagaaacttctataaagtaaccagctttatgcatcagaaatgtcaaaatcaagagacagcaggaagtgttccaaattgaagtggaccaaagagacataacagtgaaatgcaaagcatgatcctgaattggatctaaacattattggaacaatgggtgaaactggcatttggtctctggtttaaatggtaaaattgtgttgatagtaaattattaattttgatggttgtactgtggttatgtgaaagagtgtccttggttttaggaaatacacactgacatat

SEQ ID NO: 346328 - DNA, 328 bp, Homo sapiens
ctcctgatataatgaacctagaagagcatggcatcatttctgcagtattcttgccaaaaatacataagccacatctaattccaaggaaacataagaaaaattcaaagcgaagaaacttctataaagtaaccagctttatgcatcagaaatgtcaaaatcaagagacagcaggaagtgttccaaattgaagtggaccaaagagacataacagtgaaatgcaaagcatgatcctgaattggatctaaacattattggaacaatgggtgaaactggcatttggtctctggtttaaatggtaaaattgtgttgatagtaaattattaatttt

SEQ ID NO: 346329 - DNA, 484 bp, Homo sapiens
tgatgctcccacattcctagatgtctgaggaaccctcagaaggaaatcatcgaggtctttcaccatgtggccatgccaattgtctcatcctgttcttcagcatctcccatcaagatctccagtggcctcacaaattacaaccagtctctaaaagctgaatgtcaacctgcccttcaaaggccctgtgtcccagtgccaaaaggcagtagtttaaagaaacagggaacagtcttgctggggcctacttctcgttggaaggagtgtacaaaatctgaccttgccagtgggtggcctctatccagccctcaaggcatcctccaggcagttctcttgtggagcactagtcagtggctctggaggcaggattcccagtggtgcagccacaaagcttcacctgggcctggcccctgaggacaatattaaaggatctgtgttgggagcggcacatgcgttgggagcggcacatgcgttgagagcggcacat

SEQ ID NO: 346330 - DNA, 821 bp, Homo sapiens
ggttgctggctttttcaggagctgctcgctcgcagccagagacgctgctttttttttccgggttcggagccgttccggatgctttaggctgccggatgtctgatctccggataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagagatgcagtttcaccgtgttgcccaggatggtctcaaactcctgggctcaagccattctacctggcgtcaagcctttcccaagacgttacaagggtgcccgtacaccctgagccccgggcctaatttcattatatcatcgaacaattacgaaaattttcacaggaaacaaacgggggttatcacccagagagtatggaccacacctgggacatcgagataccgatagcacccgtgcgaattctgggcccaacataggctttcgc

SEQ ID NO: 346331 - DNA, 2769 bp, Homo sapiens
ggttgctggctttttcaggagctgctcgctcgcagccagagacgctgctttttttttccgggttcggagccgttccggatgctttaggctgccggatgtctgatctccggataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatatagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggccttgctttccctgcaagttcattaaatgtagaatgttgtctttttaagacaccgtggctgagtgctcctaagccatctgttaaatgacttcccgtggtctgcgtgtgtgtgttcatgtgtgcgccagtgatgggcctctcctcaaacccacgactgtctgcagcgtctcagccgtcagaatgaaaacattatcaatcagtacccaacaacagctgtttttgacaagtttctgtctgacgcctaatgctttacaactgtcaataaggctccctctttgtctag

SEQ ID NO: 346332 - DNA, 2759 bp, Homo sapiens
gtgcagggcaggggtggcatgtcgcctctcggatctcggcgtgcccgatggccccctgccttgaggagcagcctttttgctttctttctttgggataggatgcctctggggttctttctcccgcagccggctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatatagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggccttgctttccctgcaagttcattaaatgtagaatgttgtctttttaagacaccgtggctgagtgctcctaagccatctgttaaatgacttcccgtggtctgcgtgtgtgtgttcatgtgtgcgccagtgatgggcctctcctcaaacccacgactgtctgcagcgtctcagccgtcagaatgaaaacattatcaatcagtacccaacaacagctgtttttgacaagtttctgtctgacgcctaatgctttacaactgtcaataaggctccctctttgtctag

SEQ ID NO: 346333 - DNA, 672 bp, Homo sapiens
ctcagcctcccgcatgccaccacactcagcaaattttttgtattttttgtagagatgaagtttcaccgtgttgcccaggatggtctcaaactcctgggctcaaacgatcctcctgcctcggcctcccaaagtgctgggattacaggtgcgaacaactgtgcccggccaggtcatttctttatttcatcccttttctcatatattccaagtctcttgctcaagctgtttaaccactcccttgtggactttttctaaagccccatatctaggctgtttgtctacagaattgatgatacttttaaactccttttagttaaaacccaagtatttgttcaaaccctgttgtgtttttggctctgtgccagacatggtggtgtttaccatgtagttctaaggccctgtaagatccctagaaggatcttaattcattttctatccttcacttgctgtgatttttatctcccatgcccatgtaacatggggtccagagttgagatgagtgtctttcttgttccttactgccacttccagaccatttatcttgcaattaaaaattccatttccttttaattttaagccattgcactattctacctactactgttctggacacattttgtacagcttcctgttgattctgaccatcattcatagaagcttttgagcgctggt

SEQ ID NO: 346334 - DNA, 2487 bp, Homo sapiens
ggttgctggctttttcaggagctgctcgctcgcagccagagacgctgctttttttttccgggttcggagccgttccggatgctttaggctgccggatgtctgatctccggataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatatagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggc

SEQ ID NO: 346335 - DNA, 537 bp, Homo sapiens
ggttgctggctttttcaggagctgctcgctcgcagccagagacgctgctttttttttccgggttcggagccgttccggatgctttaggctgccggatgtctgatctccggataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggtataacatttcaaatcatttctatgtctgcccttaacttttatgaatttggtaataatgtattatatgtaattcaaacataatgataacttattttagtaggtggttcatttttatcttgataatatatttcctagaaatatttccttctcttcgtatgttttaaaaattgttgaagagttctaagta

SEQ ID NO: 346336 - DNA, 1257 bp, Homo sapiens
tgcaattttcagtaagagccatgtctactaacctttgtttctagtattcactgaaaacattcatatctaaacacagtttttggtgagtaaaatattttctatatagttttgttcaaataagagattatgtattaacatacttgttcatatttctctttttagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaatcgtgtgtttaattttacatcaaccatatagcatatatttagcaatatgacagtctactgattttggctttgttagaatagagaataagtgcaaataattaaatcctatggctgtattaacaagggggccattgattataaaacttgaactcaggtcctttta

SEQ ID NO: 346337 - DNA, 1029 bp, Homo sapiens
agcgggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggtaaattacttaaatctagaagtggggtttggttttaaaaagttattggcattatcttggctgaatgtttgctatagaatatagtataattttgttattttgcaatgtatacatttaaaacttttttaatatagtaaaatttttactttaaaattactttgttccaaactaagtatgatatcaagtgggttatgaatttataagccttattttgaaagtagcaggacgtataagattaaatgtatccagatggctaaatgtgttccccatctcccaccaaagtaaaattgcattccaaaactacagtgttaataattaaatgaaactctgtaaataaaagatacttgtgggtttaa

SEQ ID NO: 346338 - DNA, 3138 bp, Homo sapiens
agcgggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctgggggctgaaaaacaatcagctaatttacgggcagaacgcttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttta

SEQ ID NO: 346339 - DNA, 2388 bp, Homo sapiens
agcgggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttta

SEQ ID NO: 346340 - DNA, 2613 bp, Homo sapiens
acctctagaatggaagttgcatgagaggaggaacctttacctgttttgttcattgttatattccaagttcctagaacagattttggtatacatccagagatcaacactttcctcatactatacactttatcataatgagaaccagtgaagaaataagattaattgaatggtaatttactttttggatatcttttcaggaatgtactacttctgtatgtaggatacttgttatgaagacctttccaaattcatttgtatttctgttaaatttattttttacttttagagtggctatcattataatgtaatttaaaattatatttgtaaaagtgactattggagtgagtacgaattttgtttataaatctatgataaatgcattctccctttaggaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctgggggctgaaaaacaatcagctaatttacgggcagaacgcttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttta

SEQ ID NO: 346341 - DNA, 1093 bp, Homo sapiens
tgcaattttcagtaagagccatgtctactaacctttgtttctagtattcactgaaaacattcatatctaaacacagtttttggtgagtaaaatattttctatatagttttgttcaaataagagattatgtattaacatacttgttcatatttctctttttagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttta

SEQ ID NO: 346342 - DNA, 261 bp, Homo sapiens
gctaagagtgagctagaaagagaaaggaataagattcaaagtgaactggatggtaatatgtgatttcccttgctgctgctgctgctgcttattttcagatatgaactcaaattattaaaatagttgaatctgaatttttatttccaaattttcaacttaatttagttttaattttggagtacatatgaaatgtttattatatgttgagtgttttgttcattgtaagatttaataactttaaaaaaatcagtcttatgtttt

SEQ ID NO: 346343 - DNA, 765 bp, Homo sapiens
gaagaaaatagctgaactaagggtcaatggaatgtgattttagttccagctaagatacttaaaatcttgtatgaccttaggcaagtaatctaacttctcagggtttgttattttcattagtactgcctatagtaagaatactaaaaaaatcatataaagtatgcagaatagctttaaaaatataagttgttatgatgttattttaagatatcatttatatgcattttactctagtcagaagacatactgcattaagatttgataccaggcttgattttcttaaaccaaatttatgaggacagatatttgtagtttgatggttattatacttcacatctggttatcaagtgtttgtcttgccattaactagatgtgagcccttaagttcgttaactgctctaatcctcagtttcctcatttataaaatggacagaagtataaaggtgacagaaatacctaactcaggatttttgtaaagaacacatagttttctaagtccagtgccttattcataggaagtgctcagtaatggtgggatttccaaacaagtggccatacaggagggcctgcagttggataattaagaatgtggtcagacaggtagtgagtttgcttatacttgtgataatatctatttaatcctaagaacttatttaacttccatgttttacatacattcttctgacaggacattggaagagaaacagatacagtggttggaagaaaagcataagcttcatgagcgtatcacagacagagaagaaa

SEQ ID NO: 346344 - DNA, 3191 bp, Homo sapiens
agcgggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctgggggctgaaaaacaatcagctaatttacgggcagaacgcttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttta

SEQ ID NO: 346345 - DNA, 901 bp, Homo sapiens
  misc_feature (50)..(50): n is a, c, g, or t
  misc_feature (53)..(53): n is a, c, g, or t
  misc_feature (701)..(701): n is a, c, g, or t
agacgaataataaagacaatagacgagagaaaaaagaggggtcctttgtnaangcccggagaggccttacagagcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaccatactacgataatgcccagtgttcattgcaaagataaattctaaatggtacctcaaataaaagacaagaaatagacaatgccaagcacaaaacagctatacttacgacaacacacaccattgtgtcttgcgtccatggtgtccttcatgaaccttgtcagtatctaagccagagattgagcgccagattaatatctggtantcaacgggcaagaccaggactactgagaatacgaccgaatgccataagtatataatcacgcgtgtaactatcatccaaccacccccgcaccccgcaaaaatcatcgtattccagaccccaaacctataatgcgtatgttggagcgccgtgcaagtagctgtcgcatgttgtttgagttgtgccgacacggagatgtacag

SEQ ID NO: 346346 - DNA, 3302 bp, Homo sapiens
agcgggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctgggggctgaaaaacaatcagctaatttacgggcagaacgcttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaatttttttttaatcgtgtgtttaattttacatcaaccatatagcatatatttagcaatatgacagtctactgattttggctttgttagaatagagaataagtgcaaataattaaatcctatggctgtattaacaagggggccattgattataaaacttgaactcaggtcctttta

SEQ ID NO: 346347 - DNA, 3242 bp, Homo sapiens
agcgggacagagcccgctcctccaggctggtggggcggtgcgatgaggcggcttctgggccatacgtcagcacgtggggtggcgccgcacccctgaggatcccggtccacgcggaggagtggggcttttcaccgccgccgccgccgccctcggacctctcccgggatacttcacatttccctagggacgggagcccgaggggtccgttcggccctcttcctctcgctgggccgacaccccgctgtaggaccgtaacccttagtcccaatgcctccgtaagcggagttgagtgggtgcctgtggttggagctgtggaggtgtccccggtggcgagcgcggccagaactgcggtcacttaagttttccgtgtgcgggttgcaaggagcgtgcgtgcgtctggtatagggaggacacctctggattgaggatcttatgacctactttagaggaagagccagctttagagtttgcccctctgcttatgaaatccctatggaaaaaaggtataatttggcttcctgagattctgccttagcaagaaaggagtgggaaatacccttggaaagaaaactaaaacagtaagaaagccaaaacttatttttacatggttgtcagcacatttaccgatatggacacttttcccaataattttcctcctggtggagacagtggattgacaggttctcagtcggagttccagaaaatgttaattgatgaaaggttacgatgtgagcatcataaagctaattatcagacactgaaggctgaacacacaaggttgcagaatgaacatgtaaagttacaaaatgaactcaagcacctgtttaatgaaaagcaaactcagcaggaaaaacttcagctcctgcttgaagaactaagaggagaattagtagagaaaactaaagatttagaagaaatgaaactgcagatattaactccacaaaaattggaattgctaagagcccaaatacaacaagaattagaaactccaatgagagaacgttttaggaatctagatgaagaggtagaaaagtatagagctgtatataataagcttcgctatgaacatacatttctcaagtcagaatttgaacaccagaaggaagagtatgcacgtattttagatgaaggaaaaataaaatatgaatcagagattgcaagactggaggaagataaagaagaactacgtaaccagctgcttaatgttgatctcacaaaagacagcaaacgagtggaacaacttgctcgagaaaaagtctatttgtgtcaaaaattaaaaggtttagaggctgaagtagcggaattaaaggctgaaaaggagaattctgaggctcaggtggaaaatgcccaaagaatacaggtgcggcagttggctgagatgcaggctacagtcagatccctgggggctgaaaaacaatcagctaatttacgggcagaacgcttggaaaaagagctacaatcaagcagtgaacaaaatacctttttaattaataaattgcataaagctgaacgagaaataaatacattgtccagtaaagtaaaagaacttaaacattcaaacaaactggaaataacagacatcaaactggagacagcaagagctaagagtgagctagaaagagaaaggaataagattcaaagtgaactggatggattacagtcagacaatgaaattctcaaagcagctgttgaacatcacaaagtgctcttagtagaaaaggatcgtgaattaatacgtaaagtacaagctgccaaagaagaaggttatcaaaaacttgtggtattacaagatgaaaagttagaactcgagaacagattagcagatttggagaaaatgaaagtggaacatgatgtctggaggcaatctgaaaaggatcagtatgaagagaaattgcgggcttcacagatggcagaagagatcaccaggaaggagcttcagagtgttaggttaaaacttcagcaacaaattgtgactattgaaaatgcagagaaggaaaaaaatgaaaattctgacctaaaacagcaaatcagtagtttgcagatccaagtgacttcacttgcacagtcagagaatgacttgctgaattcaaaccaaatgctgaaggaaatggtggagagattaaaacaagaatgccgaaattttagaagccaagctgaaaaagcgcaactagaagctgaaaagacattggaagagaaacagatacagtggttggaagaaaagcataagcttcatgagcgtatcacagacagagaagaaaagtacaatcaagctaaggagaaactgcagcgagctgcaattgcccagaaaaagagaaaatctcttcatgaaaacaaattgaaaagactacaagagaaagtagaagtcttggaggcaaagaaagaagaattggaaacagaaaatcaggtcttaaatagacaaaatgttccttttgaagactatacaaggcttcaaaaaagactaaaagatatacagagaagacataatgaatttcgaagtctaattttggttcctaacatgcctccaacagcatctatcaatcctgttagctttcagtcatcagccatggttccaagcatggaactaccatttcctcctcatatgcaggaggaacaacatcaaagggaactctctctacttcgcaaaagactagaagaactggaaacaacacaaagaaaacaactagaggaacttggatcttccggagaatgatgttcttggagaacaggcagatcaaaagaggtgaagttggtgactcagtaaaacttgacattttaacctgtggcatttagatactttttactgtttgccaaaacacttgaatgtgcctcaagaaaaggtacctactacatgctgtattgtatgactgtcaggattttaagattatacaagtgaagcattaaaagagaaattctcagagatatttagaatatttgacaatggtttgagaatgtaaaacaaaaaggaactagttagagtcaagttttaaaatttttactttgttgaatttttttttttggcattttgagtgaaatataactatcattaattctctcttcatctttgagatgcttggccataacagggtccatacacatcttctggtttactatatacaaaaactgtagttgaaaaaagatgacaatttaaaagtcagcctaaagaatgtaaaggtatctatatacaaaaggctaccttttctaaaatctgtgtgcacataattaaagagcttaattttttttta

SEQ ID NO: 346348 - DNA, 538 bp, Homo sapiens
atttgttgccagaagaaagaaatgatttcctaaatttgtctgtatttttcttttgcagggaatgaaggggttattaacttctacaaataaccgaaaaaaagaaggaaagcaaccataaagtttgtttccttttttatgtaaaaacagtaatggtgagaatgacaaaaattttaaagagcccatacacagtgttggcaaaaatgtgcagaaataggaagtcttctatactgctggtgggaaggtaaaagagtacaatatttctggagggtgactatcaaaatgttaaaagggcatgtcctttgaatctgcaatgtcactctcaggaaatcatcctaaggaaataatcagaaagatatatttagagcacaaaaaatataatataaagtccaagggaaggagagaaaaaatataaaaatttatatactgcattattgtaattttaagtttttttaaaaaaataactgcatagaaaataactgaaaagaaaacatcaaaatgttacatagaagtggccgggcgtggtggctcatgcctgtaa

SEQ ID NO: 346349 - DNA, 342 bp, Homo sapiens
accattgtataatggatgctttctggatggtggcatattgggccgtaaatatggttttaaatatagcgccatacttgcttcaagatcttgtttcctgtttcacaaagagcgattggtcttcctcgtgctgagaaaaaataacatttgaaatgcagaatccagcctgttccccagggctggctttccaccaggttcctgtggggaggtcaagcaggtatttcagcagggcagtgtcatgttgctccatatcctggccacatctccctttagactccacatcccaatatctgctgttcaattccctgggtaattaattaccctacaggagccaatagaatcctg

SEQ ID NO: 346350 - DNA, 835 bp, Homo sapiens
tcacgcctgtaatcccagcacttcgggaggccaaggtgggtggatcacctgaggtcagaaatttgagaccagcctggccaacatggtgaaaccccgtctctactacaaatacaaaaaaattagccgggcatggtgacaggcacctgtaatcctagctacttgggaggctgaggcaggagaattgcttgaacccaggaggcagaggttgcagtgagccgagatcatgccattgcactccagcctgggtgacagagggagactgtgtctcaaaaaaaaaacaaaaagcaaagaaaagaaacccttttattctctttctcccctagaagtaaccattatatcttgaaattggtgtgaatcatttcggtgtttttgtatgtgtgtgtatacacagagatatatacatatgtatgtaaaacaatctgtatgttttattgttacactttttcttatgtagtctgatttcttaaagttcacattgtatttcgatattaatctatgttaatatatatgaattatgttattcattttaactactgtggagtcataagtccactgtatgaataaactgaacagtttattttttttctgttagcagttgcagtgatcatcctttttttgattccttatgttcatcttgagagctggtttagggagataactggaagaagaattagtaggtcttaaatcatcacatgtttagctttactaggaactgccaacagttgagttatcagacttgttaatttttgtcaatctgacggatgcaaaatgatgttttaaaattttcatttctctgagtgataaatacaagtttgagcatttcatgttacttggc

SEQ ID NO: 346351 - DNA, 908 bp, Homo sapiens
cataagcaatttctttgtgcttaagcctattacccattctcagcctggtgtgcttctggatttaatggggacagagaagttgaaaagagtaaatctctggggtgacactgtttctaatggctcaaggggacactcttaggtctggctctctttctcatctagccatggaaacaacttatacaacctctgagctgatgtgtctctaacatagcccaatggcatcacccacattctggcacttcccttttgggacaagttaagacacaactgtatggccaagttctgttctcacttagctgctgccatctccagagtaaattttctctccagtcctttgggattttctctgcttattgtggttcaagataccatccacacttcagactctaaagagttagataagactctagtttatttagtccaacagtttatttcccaaagtatgttctgctgataactgttttctgttaaaaaaaagaaaaaagaaaaaaaaagcatccctttgagctgcaactgtttgggatatgatggattaaacaatataaaacaggtttctttactgcaggacttatgggcttcagtctgctggtacgcatcctgaagtccctaaagggtgacagtgtatattaagtattttccagatcctttttttaaaccacagatcactttttaaacacagtgtgtaattaggctagtgttctggattctcccaaattgcctgtaactttgcctatggacaggtacacatttatttaccttccactttcctctaaatgttgcttcttagtgacccatctccgatttccatttcctgcttaaactttctcattcccttggcaaacaaatgttttccttccctacttacaaaacatactagaggagatgttcattcaacaacccataacttt

SEQ ID NO: 346352 - DNA, 579 bp, Homo sapiens
gtgtgttccatgcctgaacctgtgagacatggaagtatgcttggtacccttctcccgtcttcctctgtatttgaaaatattcagaataagaaagtggaagaagaaagatgatctggctaggttgtggggaataggttggagggagattgaatgccagaaacttaggttatttatctccttttcctgggtcttttaaatctacttcctggagtagagtaagttctcattcattgctgactgaatgaataacttcctgaatcaatgatgggcatataaatgggttactactattccacaaaacacaacaatttttaacttgttgactttagacatcagtagtttgaaaactactctttcaaccccacttccctctgactcttctaccttccctctctctctctccttgcttcttccctccactcctgaatgtccctctcatgtcatgccctaaaaaggggcatcttcagagtcgtgatggaggaggacaaagatagaagctgataggaaagcttcgaagaagacaagatttggagctcactcaggaacaccaaaaacaaaaataggccgggtgcggtggct

SEQ ID NO: 346353 - DNA, 479 bp, Homo sapiens
ttgcacatttccttatggaaatctaactacatgttagagaatgctcaaggtctgcaatgtttacattgttgcccctacataaggaatatatgccttaagataaaactaatagctcttagccctcttacaccattgactaggattccaattctgcaaggcccaggaggagaaattgagaattagaagtttcaccgagaagaaataaaaagatttggtttgcattatcaaaatttctgtaaattatatggaaattttgaggatggattaggctggatttattagcagtggacacgcctccaatattccttcagcatgccatctcagtggattttgattggctcttgtaggattggacttaatgctagcttatgccaaatgtcatcaaaaagccagaatgctactacagtaatgtaaaggattattgtatatagtgtaaaggattattatgtgtaatctttaatatataatgtaaagactta

SEQ ID NO: 346354 - DNA, 680 bp, Homo sapiens
ttgcacatttccttatggaaatctaactacatgttagagaatgctcaaggtctgcaatgtttacattgttgcccctacataaggaatatatgccttaagataaaactaatagctcttagccctcttacaccattgactaggattccaattctgcaaggcccaggaggagaaattgagaattagaagtttcaccgagaagaaataaaaagatttggtttgcattatcaaaatttctgtaaattatatggaaattttgaggatggattaggctggatttattagcagtggacacgcctccaatattccttcagcatgccatctcagtggattttgattggctcttgtaggattggacttaatgctagcttatgccaaatgtcatcaaaaagccagaatgctactacagtaatgtaaaggattattgtatatagtgtaaaggattattatgtgtaatctttaatatataatgtaaagacttaaaagtgacaagaatactggattggttctattccactcactctgtcccttactagcaagacaagacccaaaataatcccttctccccatgagtaatcagttgatgaagttaaaactatttcaagagctttactggcctggcaagaggagatgaagttgaaatgggatcccacgttagtactaagagaccagttaatcactgt

SEQ ID NO: 346355 - DNA, 2823 bp, Homo sapiens
aggtttgagggggaatgctggagattgtaatgggtatggagacatgtcatataagtaatgctagggtgagtggtaggaagttttttcataggaggtgtatgagttggtcgtagcggaatcgggggtatgctgttcgaattcataagaacagggaggttagaagtagggtcttggtgacaaaatatgttgtgtagagttcaggggagagtgcgtcatatgttgttcctaggaagattgtagtggtgagggtgtttattataataatgtttgtgtattcggctatgaagaatagggcgaaggggcctgcggcgtattcgatgttgaagcctgagactagttcggactccccttcggcaaggtcgaagggggttcggttggtctctgctagtgtggagataaatcatattatggccaagggtcatgatggcaggagtaatcagaggtgttcttgtgttgtgataagggtggagaggttaaaggagccacttattagtaatgttgatagtagaatgatggctagggtgacttcatatgagattgtttgggctactgctcgcagtgcgccgatcagggcgtagtttgagtttgatgctcaccctgatcagaggattgagtaaacggctaggctagaggtggctagaataaataggaggcctaggttgaggttgaccagggccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346356 - DNA, 458 bp, Homo sapiens
gaggggcaggctcagacaggcaccctcctctgcccgggcaattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346357 - DNA, 1906 bp, Homo sapiens
cctccgacccctgctcagctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346358 - DNA, 2747 bp, Homo sapiens
aggtttgagggggaatgctggagattgtaatgggtatggagacatgtcatataagtaatgctagggtgagtggtaggaagttttttcataggaggtgtatgagttggtcgtagcggaatcgggggtatgctgttcgaattcataagaacagggaggttagaagtagggtcttggtgacaaaatatgttgtgtagagttcaggggagagtgcgtcatatgttgttcctaggaagattgtagtggtgagggtgtttattataataatgtttgtgtattcggctatgaagaatagggcgaaggggcctgcggcgtattcgatgttgaagcctgagactagttcggactccccttcggcaaggtcgaagggggttcggttggtctctgctagtgtggagataaatcatattatggccaagggtcatgatggcaggagtaatcagaggtgttcttgtgttgtgataagggtggagaggttaaaggagccacttattagtaatgttgatagtagaatgatggctagggtgacttcatatgagattgtttgggctactgctcgcagtgcgccgatcagggcgtagtttgagtttgatgctcaccctgatcagaggattgagtaaacggctaggctagaggtggctagaataaataggaggcctaggttgaggttgaccagggccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346359 - DNA, 6082 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346360 - DNA, 6090 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaagagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346361 - DNA, 638 bp, Homo sapiens
cagtggcagcatcatgggggcaccttcacctccgagctcatgcctagcgcctcccctccctccggagcaggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346362 - DNA, 199 bp, Homo sapiens
gtctttctccacggctcccagggccaggtttaccactcccagcaagtggggcctccaggctcagccatcagcccagacctgctgctggacagcagtggcagtcacctctatgtcctgactgcccaccaggtgagggccatcctggggctgaaggggccagcacacgcggcccaagtctcgtgcccattgcctctctgct

SEQ ID NO: 346363 - DNA, 6157 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346364 - DNA, 6416 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacaggtgcctttcctgctgccccacccctgctgtgcatatggtccactgagtcccagagagaccaggacattcccagggtggatgcgcccacctggggtttctggaacttacaggaagatctagggcccaggtcacctaggccaccaggccagcttccagcggcccctggctccgagtgtgttgccagtaggctggagtacatggggcggagatcacgatggcaggccagggcctcacgcccacgcctgccctgcgcccccagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346365 - DNA, 6542 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacaggtgcctttcctgctgccccacccctgctgtgcatatggtccactgagtcccagagagaccaggacattcccagggtggatgcgcccacctggggtttctggaacttacaggaagatctagggcccaggtcacctaggccaccaggccagcttccagcggcccctggctccgagtgtgttgccagtaggctggagtacatggggcggagatcacgatggcaggccagggcctcacgcccacgcctgccctgcgcccccagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccggggaggcatggcccggggggtgcgcctgtccacacgtgggtggaaagactagcagagcagaggggggagacttggggcttgaggaccaggctgggacctcactgcccccctccacgtggtgcccccagaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346366 - DNA, 5911 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacagagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttaaaaaaaaaaaa

SEQ ID NO: 346367 - DNA, 5093 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagagtgagtccctcggccctgacctggggccactggagtccaggctgggcaggca

SEQ ID NO: 346368 - DNA, 648 bp, Homo sapiens
caggctggtcttgaactcctgacctcaagtgatctgcatgccttggcatcccaaagtgctgggattataggtgtgagctactgcacctggccaatgaatctaattttaccagagactaattgatacaaacaagagttaagttcctactgcatatttctggtcacgaaaacatcaccaaacttccaaataaagaccccaaacactttaaatgttacacattaaaataaactgagctatgtatactttaaaagagattagttaagaacaagtaagaaaattacttacccagtgattccagtttagggtcataggtggccagaacctgtcttggcagttctgggtagcttaggttacaaggcggaaatctgccctgggcaggatctattctatcgcagggcacacgggcacactcactcacactggctgagactggaaccatttaaacaatgctagttaacatgttgtgcacatctttgggatgtgggagggcgctggagtacctggagaaaacccgcatagacgtggggagaacacaggaaatccacacagacagtggccccagtgggggaatcaactccactccctattaacgttttagtgaaatgacattatttgaggacctgctgtataacatgtacattaggggta

SEQ ID NO: 346369 - DNA, 131 bp, Homo sapiens
ctgcaaccattccatcacaatcattctcaggaaaaaacaataatcggtcagaaggaatttttagaatttttttgattctatatttgcttcattctttttcttttttctttttatgagttggaatttcgctc

SEQ ID NO: 346370 - DNA, 247 bp, Homo sapiens
gttaaggtgaggtatctcttcaagttcacagttctggctgtggcagcatgctacagccttcacgcagcatcagtgatggtagaaaacccagccttgggcaaggctaccactgcatggcaggaaaggacccaagctacatgctggttactccagaacactactcacattcttgaaaaaagctgcagccaggatgagtgggttgggaagaggcaggagtaccttgggctccgagtcattattcagttcc

SEQ ID NO: 346371 - DNA, 403 bp, Homo sapiens
tttttttttttttgcccatttaggattcaagatgggttttaaccttttaagttacaattaagcactttgtgtcgtacagtatgtatacaataatgctttgaaatggctagtcatgaatgtattaatggtttgtcttgcactgaaacctgaaatgtagatgaaaaagttgataaacataaggcaatcagtactgattgtcattgtcatctaccccagtacattctaagtgtggtagatacagtaattcttatatgttgctattaacgtcatttctgatttttgattagaaaaatatttaggttaatggctttcttgttggtttcaaatttatagtaaaagctatacctttatgtcttgaatctgcttgccagtctttgctttgataggtggtttttgcttaggc

SEQ ID NO: 346372 - DNA, 940 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccttcctttcttgtagtttttttttttatccctgctgttcccccc

SEQ ID NO: 346373 - DNA, 4952 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346374 - DNA, 4719 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaacacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346375 - DNA, 4502 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaagttgctagggggatcctctcaagtcga

SEQ ID NO: 346376 - DNA, 4159 bp, Homo sapiens
ctgttttgtgtgacacaagctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346377 - DNA, 4842 bp, Homo sapiens
  misc_feature (3742)..(3742): n is a, c, g, or t
  misc_feature (3744)..(3744): n is a, c, g, or t
  misc_feature (3755)..(3755): n is a, c, g, or t
  misc_feature (3758)..(3758): n is a, c, g, or t
  misc_feature (3763)..(3763): n is a, c, g, or t
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggagaaaaaaaaaaaaaaaaaaaaaaaaaaaaaaaacccgcgcgcccagtttctaacacactatntncgcggaaaganttntttgnagggggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346378 - DNA, 5101 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaagggtgtcacgttttgtctttattgctgtactagccttgaatttgtcctaaagctcttgcaaggtgcctgcttcctgagaaagatgtggttatagcacacattcatctaaactcagtccttggcatgaatctgaggacagggcttatccaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346379 - DNA, 4898 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgtgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346380 - DNA, 4944 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtaaccgcgcgccggcgggggagggcgtggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagttcaccactgacatacggcactcccagctctcgggtagagggaaccccaagaagtggtgttaggggcacacctgtgagacagaggcctgacctgggctctgcacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346381 - DNA, 4820 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaaatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346382 - DNA, 3414 bp, Homo sapiens
acttcgctccgtccggaccgtcgctcctttgtggccaagtttttcatcgttgtgtctgcagagctctgagcactcgcttcgcgtcgcggggtctccctcctgttgctttcctaaccctgccctccggggcgtaaataaagtctgcaaggaacccacggcgtgggttcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346383 - DNA, 2978 bp, Homo sapiens
  misc_feature (2896)..(2896): n is a, c, g, or t
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggctcatgctgaccctccngacgaacctatacaagcgtctggctcatccacctgtcgcacagtactacacagagcgaggacgctaatctgctgaggatacc

SEQ ID NO: 346384 - DNA, 2371 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagcttgaaggattttcacgcacagggcacattttggctgtcccaagtactttggccggggacccagggcacggcatttaggacacaccggcgcagggggcaaattacggagctgagaatcaagcttcttgcagtgattgggaacccttggtacccagcaagttcccacggcgagttaagtgtatacaccatgtaccc

SEQ ID NO: 346385 - DNA, 2133 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatggtgcgcagccaccctggccccccaggctatgctttgcctgtctgtatcctcaaaaggccaactataacttgtccctcggaccctgagcctcacttcccgaatggcatccatccctctctggtcttgtgggtttcgttagtggcctatgggctaaatatgcagagcacgcaaagcccctgcttcagggcactgtccctgtgctgttgccagtggcactgtctgttgttagagacactgtattttcatggcctaaaatgcttcaaacgtttgagatgagaatacttggttaaatgtcattctgctttttccattggtaaaggattgaggaatttttctga

SEQ ID NO: 346386 - DNA, 1957 bp, Homo sapiens
  misc_feature (857)..(857): n is a, c, g, or t
  misc_feature (859)..(859): n is a, c, g, or t
  misc_feature (870)..(870): n is a, c, g, or t
  misc_feature (873)..(873): n is a, c, g, or t
  misc_feature (878)..(878): n is a, c, g, or t
gaacctaactttatcatacataagcgtctcgaagtcgcgttaaggaacgttaccagtgaatcactagactagtttactgtaagaggagcattgccttgtctacactcgtatgtgacgtcgcatatgcgacttttcatcgacaccaattgacacgaatactacacacgagaccgggagaagcagagacagttacgtcgtagacagccattcgagaatgagactttacttgatagtcttaatgaggtcggaaatctacctagctcgtgaaattaccaggcaacttctatgatacgattttcggggagcaatcgtgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggagaaaaaaaaaaaaaaaaaaaaaaaaaaaaaaaacccgcgcgcccagtttctaacacactatntncgcggaaaganttntttgnagggggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346387 - DNA, 366 bp, Homo sapiens
ttggctccaagcatttatgaacatgaagatataaagaagaaggtaacagtggattttaaactaggggttgggatttacaattctttgggatcaaatagtataaacatccactccgccactcgagccatccgccataaaggacagagttgtggcctgttagagcaagtgctggcaacctgacttgccattggttgagaagaatcatagcattgtctatcctcatctctggtctaaacttaggtttctaaacagaagaggccacacagtgtcagaatagggacttgcatggccaccattctggtgtaatgataggtgctgatgaactggtcagtgataacttaaagcatatcaagcactttcacgagc

SEQ ID NO: 346388 - DNA, 3943 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtaaccgcgcgccggcgggggagggcgtggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaa

SEQ ID NO: 346389 - DNA, 4880 bp, Homo sapiens
  misc_feature (3780)..(3780): n is a, c, g, or t
  misc_feature (3782)..(3782): n is a, c, g, or t
  misc_feature (3793)..(3793): n is a, c, g, or t
  misc_feature (3796)..(3796): n is a, c, g, or t
  misc_feature (3801)..(3801): n is a, c, g, or t
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggagaaaaaaaaaaaaaaaaaaaaaaaaaaaaaaaacccgcgcgcccagtttctaacacactatntncgcggaaaganttntttgnagggggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346390 - DNA, 3826 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaa

SEQ ID NO: 346391 - DNA, 4813 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346392 - DNA, 4324 bp, Homo sapiens
  misc_feature (4245)..(4245): n is a, c, g, or t
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctggttttgactcctgagctcngccgtccgcccgcctcggctttccagtgctaggattacagttgaccctgcacctgcctcatgcccgctatttctgtttt

SEQ ID NO: 346393 - DNA, 4010 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggagaaaaaaaaaaaaaaaaaaaaaaaaaaaaaaaacacaaacaaaaaaagccccggcacatttttcacaaatttccggaaaaaattttttcggggggcccaatattatatatgagatataatagcccagaggggcgcttataaaccccgctggtgttttattgcccagaatattgcacctcgtggggccaaatgggtggaggaggcgggagaacacatctccagagggaccacacaccgaattgtgctcatagaggaatttgaacaaaacgggatataaggcgggggaatatgc

SEQ ID NO: 346394 - DNA, 4387 bp, Homo sapiens
  misc_feature (4215)..(4215): n is a, c, g, or t
  misc_feature (4228)..(4228): n is a, c, g, or t
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatggagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaacaaaaaaaaaaaaaaaaacaaaaacaactttttgggggcctgggggccccaaaaagtcttttaacaacctcgttgggggccgggccctgggtggtgaaccctgggccccgcgtgcccgggaacccgggccacgaactaggggtgggtttccacccaataaaaaaacggccggggcgcaccgggctggttttgaacaaccccatggggcttgagggcattcccggtctcacccagggagccagcaatcgatatacccgnccagctgttgtancgtcaaccacaccatcaacagtccatgatcacatactgacacgacgcccatacatccctcagcgcgagaaacccactaagcgatccgccactcgacatcgcacactatctgagcagacgaccacacagtcacagaactaaatactacacaccgagtaca

SEQ ID NO: 346395 - DNA, 4852 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346396 - DNA, 4723 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346397 - DNA, 3454 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaa

SEQ ID NO: 346398 - DNA, 4198 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346399 - DNA, 3035 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttccgttgaagccgtgcgggatcctctagatccacc

SEQ ID NO: 346400 - DNA, 4066 bp, Homo sapiens
tggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaaatcaagcttcaggagtctccggaagacatgcctgcagggcagacaccacacacagttatcctgtttgctcacaatgatctcgttgacaaggtccagcctggggacagagtgaatgttacaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggcaggagaatgacatgaacctaggaggcggagcttgcagtgagccgagatcatgccactgcactccaggctgggcaacagagtgagactccatctc

SEQ ID NO: 346401 - DNA, 674 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346402 - DNA, 831 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactacaaaaaaaaaaaaagaaaaaaaatttgggggggggggccccgaaaaattttaaaacacttctggggggcggcccaagggaaaggaaaggcaaagggttccgaaaaccggggaatggggggttcccaaaaagcggggggcaggttgaaaccagggttggg

SEQ ID NO: 346403 - DNA, 846 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346404 - DNA, 684 bp, Homo sapiens
cccccggcttgcaggaattcggcaccaagcaagaggcggcggtctccattgccagtggtactaagccaaccgttgtgccgaaaaaagcccaagggcctgaacctccccttcccgttcacgaggttccccccccggttggttgagcctttcccacatgaagttggccaggggcccagtctcaacccacacattcttatcccgtttatataaaatattgatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346405 - DNA, 473 bp, Homo sapiens
  misc_feature (38)..(38): n is a, c, g, or t
  misc_feature (46)..(46): n is a, c, g, or t
gacgtggtccccggctgcgggacccggcccgtcgaccngagggctntaaactaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346406 - DNA, 600 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacgatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346407 - DNA, 697 bp, Homo sapiens
cacatgcacccatacacacgtacatatatatacgtttacatatttttctatatccctttggaagagttccaaactcttgtaaagaaaccaacttttagaataatagtgagtggttataatgttcatcgctcttcattgcaactattttaaaggcctatgttaaaccacatagagtaatggaaatttttatgtaatacatagatatcagtaattgagcaaggtgaaattgaatcatagtttacatctttaacaacttgagatatggtaaataatctgcaggcaatcttttggacccttttctcacagaggattataagggaacaaatagtaagtatatctcagatgtgttgacatatactcttgatgataaatgaacattaagttaagttataaaagctagcctctgcttgctgtgcttttcaggtatcctctttaattctgtttctgtggatttgtctttgttttttcctcctagggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346408 - DNA, 275 bp, Homo sapiens
  misc_feature (1)..(1): n is a, c, g, or t
nagaagaaaatgacacatcacataatcacacacggtcgccttccagctaggcaggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346409 - DNA, 287 bp, Homo sapiens
agatggggtggtgacgttaagttaattcgcatttgtgaacatggcgcgtgtttttgagctaggacagatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346410 - DNA, 450 bp, Homo sapiens
ctgtttgaaacgtgtttttttttcttgtttttctgtaggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggtatgtttggtctgtttttgacaaagtcaagataatgattttatgttcttaaccttaatgaaaaccaattaagtatacagaatttgagttggaatccagtggtttcattgtatctaatccagtggtttcagactttaactacatcagaacacccacctccaaaaa

SEQ ID NO: 346411 - DNA, 620 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggtaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctatgcagtatttatagtccatgtataataaatacatctcttaatctcctaataaattggacctttaaactaca

SEQ ID NO: 346412 - DNA, 615 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtagcagtatttatagtccatgtataataaatacatctcttaatctcctaataaattggacctttaaactaca

SEQ ID NO: 346413 - DNA, 616 bp, Homo sapiens
ttcggatcctggcgtttgcctgcagcaagatggcggcggtctcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggcgttccagaagagcatataaaaactagaaaagtcaggatctttgttcctgctcgcaataacatgcagtctggagtaaacaacacaaagaaatggaagatggagtttgataccagggagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttcctccacaaaataggttggcactgactatatctctgcttgactgtgaataaagtcagctatgcagtatttatagtccatgtataataaatacatctcttaatctcctaataaattggacctttaaactaca

SEQ ID NO: 346414 - DNA, 872 bp, Homo sapiens
ggcggtctcaatgtcagtggtactgaggcagacgttgtggcggagaagggcagtggctgtagctgccctttccgtttccagggttccgaccaggtaatagaattttcacacttttcttcaagcttcttgggtccctccatttttgcggagtctctgctggctgagttccggaggaggcctcggggaaggcgtcctctgttgacccttttctcgggagaagtcgggcggactagggactgtctgctatcaatgggcgttggccaggcgagtgagggcgtgagtgcgaggccggggaggaggacctgtggttttctggaagctttcgtattcggcttgtcgctgagggagagggtccgtggaggttttgcctccggagctgcaagctgaaccttagccctcagagaaggggaggagtctcactgatttctgtttccactttctgcatcccttccatttgtcacctgtttgcccaccactccagtccttacagaagggttaaatcactgtatcccttccatggttttaagtggttttaatttggtttctgcataggaagattgtttattcatcagtctgcttgggaggaaaacttgtttggaattcagtgttagtaaaaatatcactgctagtaatattggaaggtaatttttaaaaggctggtggtaatgcctggaggttttctagggattttgttaaagcctcacaataattcagggattgaattgagttgttgagggctctttgcgtccttgagaacctaaagtagtacttttccaaagtattgtcagattcagttgtcagttgattgagttgttactgtttttccttgaagcatttttgtgatgatttttttttttttggctgtattaacc

SEQ ID NO: 346415 - DNA, 701 bp, Homo sapiens
tacttgcttaaaaagttttgacatcaagatactgaactgtatcacgttttaggaccataaaatcctaatagtggatgcgtttaaataataggttagcatactttataaatgttagtagaataggaaagtcttcctggtgtataaactaaacactagaaaagttgaatggaccataataatttatgtaattatcaaatagctaagtaatttcagcttttgttacttgcttttactatctcagttttttgtaattaaagtctctaaagtattcattaaaatatttgtaataacatggttgaagtaaaataacttgtaggaagtttttgataataccaaaacttgataggcagcttcaattttttttctttattttcagtaatctatgccagcaattatgacaatgttagcagaccatgcagctcgtcagctgcttgatttcagccaaaaactggatatcaacttattagataatgtggtgaattgcttataccatggagaaggagcccaggtaaagtagccaaccaaaactttataacattatgacagtgtaacagagttgttgggtttagaataaaattttaaattatcacctttaaaaaagatattccatagtttgcattaatttggaattctgtattaaccataatgaaaattggtttggagaaagaaattgcatgtttgacatggttagagtgggttgt

SEQ ID NO: 346416 - DNA, 475 bp, Homo sapiens
tttgagtatttctgaacatcaataatagaatctctgtccaattagaatttgtgccttgctcagtagttttcattttaatgaatgattcaaaagaatacattagcttaagttttgttttttttaataatattttagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagaggtaagagtttattttggagcttattgggagagcataaaatcatttagatattgagtctgactacaacctaattctgtcaagacacatagtcacacatatgcac

SEQ ID NO: 346417 - DNA, 494 bp, Homo sapiens
  misc_feature (3)..(3): n is a, c, g, or t
  misc_feature (15)..(15): n is a, c, g, or t
gancacagtggggantaataacaaagggtatcaccttttgtaacattaatgttaaagtttgggatatttgttcaccatgaaacattgtgtttattttccttgtcttggcttttccacggtggctcatgccactgttcccagccgtggataattcttatatgataaatggaatttgctttttttcctccaagaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtaggtgattctgatttcttacacaatgcagtataaacaaaccacttctcttctactgccttaagtcaaacatttgatgttttttacagatttaaatcagacctcccatttcccaaatg

SEQ ID NO: 346418 - DNA, 331 bp, Homo sapiens
cttcgatcgagctctgaccactagtccacggttgtaggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatg

SEQ ID NO: 346419 - DNA, 4213 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346420 - DNA, 4245 bp, Homo sapiens
ggagaagcggctgcagcggccgcggcaggagcagcgggagctacagcatcagcaagagcaacagtagctacagccccggcggcggtgcctgttccagtctttgctgctgcagaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346421 - DNA, 4484 bp, Homo sapiens
tacttgcttaaaaagttttgacatcaagatactgaactgtatcacgttttaggaccataaaatcctaatagtggatgcgtttaaataataggttagcatactttataaatgttagtagaataggaaagtcttcctggtgtataaactaaacactagaaaagttgaatggaccataataatttatgtaattatcaaatagctaagtaatttcagcttttgttacttgcttttactatctcagttttttgtaattaaagtctctaaagtattcattaaaatatttgtaataacatggttgaagtaaaataacttgtaggaagtttttgataataccaaaacttgataggcagcttcaattttttttctttattttcagtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346422 - DNA, 4066 bp, Homo sapiens
tttgagtatttctgaacatcaataatagaatctctgtccaattagaatttgtgccttgctcagtagttttcattttaatgaatgattcaaaagaatacattagcttaagttttgttttttttaataatattttagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346423 - DNA, 3459 bp, Homo sapiens
ttagcgtggtttcggccgaggtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346424 - DNA, 4295 bp, Homo sapiens
gtaacctgtatcaatacctcactttttatcatgtctgaagaatattctcattgtatgaatattcagtattttgtttgttctctcctctgtgatggtacatttgggttgtgataccacttattggcacccaaggccttttaaataaatgtcgttccattaggagacatgataaaaatacatattgatcaactactatgtgagagatttttgaagtgctttagggcatgtcagaagaagcagagttactccagagtttgctgtctatttgataagtattgaaatctgagttgtgatgaataaaacatgaatttttattttcccttaaggtgtaacaagtgaaaagcaatttgaagttggtaatgtttaagaattattttaacagttttggtcttctgtgtaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtaacagagcggttggttgagtgttcttcctgttgcatactgtggttttgaggtctgaatccaaatacttctaatctgtgtaaataaattagctataaaaagagaacccaacaacttctccatgagtgtggaaaactagaacatgaaaggagttgagtctagaaccttgattctcaagagtgtggtccttctctcagtatcaacattggttgtgatttcgttaggcaaattcattggccacctgccaatctactaaaccagagtctaggaatgagacacaggaaactcctgtaacagaagttggttaaaaaaatcacattaaaacacacttaaataattataaagccatttttgtagaattacagtgaaaaaaaattttttcttttggagacagggtcttgctctgtggctcaggttggagtgcagtggcgtggtcatagctcactacaatcttgaactcctagactaaagcaattctcttgtgtcagcctcccaagtaattggttgcaggcacacaccaccatgcctagcaaattttaaattttttagttttacttcatttatatttacatagttttttctgttgtgctttaagccccagtatttttattgttttagagattgggtgtcattttgtgttgctcaagctgctctcaaattcctggccacaacagttctttttgcctcggccctccggaatagttggaattataggcatgaatccctacacatggctggcttgtggtttttttggttttgtttgtttttaactaagcttctacactaatgatttcagtgatctaacgatttttttcttgattgatatattgttgagtataggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346425 - DNA, 4368 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttatttttcctttattgactcatttattcctatattaatgatagtgggtatttgtgtttaagcatcaagtaacattttaaatgaagttggaccccttgatttacaaacaagatttctaaggttattgttcctagtaaatgcagcagttgtgtaaaatg

SEQ ID NO: 346426 - DNA, 4157 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatgaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346427 - DNA, 5058 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggtaaataaaagatgttcttttattcatttgcctgccaatccaaaaatacaaatatagttaattgtacataggaaggtattacttgttcagagttttgagtgtgtgaattacatatatgaacatctgagaaaatcctataagcagtttaatcaactgttccactccactccaagtgagtccataggcagaattgagttatggggagagcggcctagtaataattggtttgcgtaatacaaagttctactgggtagtgatgttgtagaagttcatatagaatcagctgagctttcagaaatggtgaaagggtggtaatagtcataacttagattgtaatttttttcccataggcttttaaaaaatattcatgaggttctttttttatttcaatagtttttggggaacaggtggtttttggttacatgaataagttcttcagtggtgatttctgagattttggtgcacctgtcatgtgagcagtatgaactctactttatgtgtagtcttatccctcatgtgtatgaactccaccttatgtgtagtcttatccctcacccactcctgcccttccccacaagtccccaaagtccattatatgatctttatgcctttacatcttcacagtttagctctcacacaacttattataatttataagtaagccagcattggatatagttgtattccattattaatttaagaaaccttatgcaagtaattattagtcatcatcccaaaaaaaagggagaacagggttagattcagaatactttgataagagctaaatactatcatgagtgctgtcagtctgtagtaactttccattggtattctatgtcttttaggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346428 - DNA, 4158 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346429 - DNA, 4154 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatgaaaacaactctggcttttgagatgacttatactaatttacattgtttaccaagctgtagtgctttaagaacactacttaaaaagcaaaataaacttggtttacattta

SEQ ID NO: 346430 - DNA, 4160 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346431 - DNA, 1386 bp, Homo sapiens
aattcttgcatatatgtttaatttggttgaattgatgcatgcatggtgtaaaccagcagtatgtgaagtgtctgtcacaacagaaaagatatgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346432 - DNA, 1185 bp, Homo sapiens
cctggctgatctagaggatcccataaaccggagatgagttgtctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346433 - DNA, 1447 bp, Homo sapiens
ggtgcatgcctgtaatcccagctacttgggaggctgaggcaggagaatagcttcagaggttgcggtgagccgcgattgtgcgattgtactccaacctggtaaacgagcaaaactttgtctcaaaaattaaaaaaaaattcttgattaaaaaaaaaaaacattattgggacgctgaggcaggagaatgtcttgaacccgggaggcagagattacagtgagcagagatcatgccactgtactccagcctggtgacagagcaatactctgtctcgggggaaaaataaatcattatttaatcattgtgttttgatttgcagtgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346434 - DNA, 1243 bp, Homo sapiens
cttttgtaatcttcccccccaccagttaacaggtttgcagttcattcagctatgtagtatactgtgtcactatcctataatttaaaacccagccactttatggataatttatattccttccttctctaaaaaggaaattgctcatctatgatttctttctttgcaagttgaagtttattgcgttgacatttcaactatctgttttcacaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346435 - DNA, 837 bp, Homo sapiens
cggcacgaggcggcacgaggcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346436 - DNA, 861 bp, Homo sapiens
acaaccagctcttacccgtcctacatagggttgtccacatagtgcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346437 - DNA, 3256 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtaagaatttaatacgatttaaatgttaagtgccagctgggcacagggcctcacgcctataatcccagcactttgggaggtcgaggcggggagattatgaggtcaggagttcgagaacagcctggccaccatggtgaaactgtctgtactaaaaataccataaaaaaataaaagatacaataaaaatactgggcatggtggcatgtgattgcaatcccacctattcgggaggctgaggcaggagaatggcttggaccgaggaggcagaggttgcagtgaactaagattgcgccacggcattccagcttgggtgacagagcgagactccgtcta

SEQ ID NO: 346438 - DNA, 2873 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttaccaaattttcgcgaccatctgctggatcagcggatcgagtgggatcctctgaacgccaa

SEQ ID NO: 346439 - DNA, 604 bp, Homo sapiens
taactaacgcataagtcagtacatggaagatatgcattgtttaagcccagaagggtggggtatcatgaaacgggcttacaggtcataggtgggttcggagattctttaatttgtaattcgttaaaggagtaaagctttgtccaaaaatttagagtcagcagaaaggactggtaagataaggaagtccgttaaccaatacactgggttaggtctacctggccaggtagacctatctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346440 - DNA, 616 bp, Homo sapiens
ggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggggccagcgccggagccgcgtgagagagggagccgtgttttggtaggggggagtcggactgcaactggcagcagagcgtctccccggccgtgtggactctacacctcctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtctggaagacctgggtgccaatactggcaagcttctagggggcccagtgtctgcgctgagcattgcggacaggacaggcaatgctgggcaccacacaaccatggacgtgactgtctaacatcgcggggatccc

SEQ ID NO: 346441 - DNA, 333 bp, Homo sapiens
ggagaagcggctgcagcggccgcggcaggagcagcgggagctacagcatcagcaagagcaacagtagctacagccccggcggcggtgcctgttccagtctttgctgctgcagtccgtgcaaccacccagccgggcgggagcatttattccccagattaattccccttttgggggggggcgggtgtgtgtgtgtgtgtgtgtctggaagacctgggtgccaatactggcaagcttctagggggcccagtgtctgcgctgagcattgcggacaggacaggcaatgctgggcaccacacaaccatggacgtgactgtctaacatcgcggggatccc

SEQ ID NO: 346442 - DNA, 568 bp, Homo sapiens
catgtgcaatgaattctcacagatatttcaactgtgtcagtttgtaatggtaagtgtttttaatttcatttttaaaaacaataataggaaagcaattatttacaagtgtgttttgttataggaaaattctcaaaatgctccacttgtacatgcaaccttggaaacattgctcagatttctgaactggattcccctgggatatatttttgagaccaaattaatcagcacattgatttataaggtacagtgaatacatttcagttatttgtcaccggatagccacatatattcttttcacatgtaaagctctcatctctgcattctaaaccttattcaaccttgtttctaacacgaggacgctgctcaggagaaatttcccatattcacacctagtaaattatttaaagtgagtttcaaatctgattctgccacttagaccatgtaattttatgaattcattttgaacaatggatttgattatattgcttttagtttgagtaagttacagtgaggtaagtcaagtgctatttctgaaaaatgaaaagttcatcttttaactgataattta

SEQ ID NO: 346443 - DNA, 595 bp, Homo sapiens
ggagaagcggctgcagcggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagcgccggagccgcgtgagagagggagccgtgttttggtaggggggagtcggactgcaactggcagcagagcgtctccccggccgtgtggactctacacctcctactcctgccgcttctgctgctgcctgtggctggagggtccccctggggctgaatctttgggacttgaccccgttccctcccccttccctcactccccagccgggcgggagcatttattccccagattaattccccttttgggggggggcgggtgtgtgtgtgtgtgtgtgtctggaagacctgggtgccaatactggcaagcttctagggggcccagtgtctgcgctgagcattgcggacaggacaggcaatgctgggcaccacacaaccatggacgtgactgtctaacatcgcggggatccc

SEQ ID NO: 346444 - DNA, 4168 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346445 - DNA, 3733 bp, Homo sapiens
tctactaaaaatacaaaaattagccgggcgtggtggcatgcatgtgtagtcccagctatttgagaggctgaggcaggagaatcgcttgaatccaagaggtgaggttgcagtgagccgagatcaagcccctgcatttcagcctgggcgagcgagactctgtctcaaaaaaacaaaaaaagtttgctcctaaagcatttactgtatactaggtaggcaataaaattccctctcagtatatctgcatgataaaatatgttcattcacttggcctgtttttgacatctacccctatatttaattgttaaagcctttttccttttaattgtgaattttaagtaaagtgtgtatcaggccaattaattttatggttccctccccccttttaaatagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346446 - DNA, 5053 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtaacagagcggttggttgagtgttcttcctgttgcatactgtggttttgaggtctgaatccaaatacttctaatctgtgtaaataaattagctataaaaagagaacccaacaacttctccatgagtgtggaaaactagaacatgaaaggagttgagtctagaaccttgattctcaagagtgtggtccttctctcagtatcaacattggttgtgatttcgttaggcaaattcattggccacctgccaatctactaaaccagagtctaggaatgagacacaggaaactcctgtaacagaagttggttaaaaaaatcacattaaaacacacttaaataattataaagccatttttgtagaattacagtgaaaaaaaattttttcttttggagacagggtcttgctctgtggctcaggttggagtgcagtggcgtggtcatagctcactacaatcttgaactcctagactaaagcaattctcttgtgtcagcctcccaagtaattggttgcaggcacacaccaccatgcctagcaaattttaaattttttagttttacttcatttatatttacatagttttttctgttgtgctttaagccccagtatttttattgttttagagattgggtgtcattttgtgttgctcaagctgctctcaaattcctggccacaacagttctttttgcctcggccctccggaatagttggaattataggcatgaatccctacacatggctggcttgtggtttttttggttttgtttgtttttaactaagcttctacactaatgatttcagtgatctaacgatttttttcttgattgatatattgttgagtataggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346447 - DNA, 2597 bp, Homo sapiens
gttggcactagtccacggtgtggctacatccacggttggctactagtccacggttggctactagtccacggttggctactagtccacggttggctactagtccacggttggctactagtccacggttggctactagtccacgcttggctaatttctttgtatttgtagaagagatggggtttcaccacgttggtcaggctggtctgcaactcctgaccacaagtgattggcctgccttggcttctcaaagtattgggattacaggagtgatccactgcacctgggccaaaatcagtttcaagacgtttgtgaattgcttgtgtgtggttttccttattagggtgtataacataaacgttaaaatgtctgctttttaaaataggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346448 - DNA, 1957 bp, Homo sapiens
gtgggtgagccgatccagatattaactttaaagtttccctttttacagttcgcatacttctaatcaatggtgcttgtaaccatttcaccattagcttggatagctgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346449 - DNA, 4213 bp, Homo sapiens
  misc_feature (4112)..(4112): n is a, c, g, or t
  misc_feature (4150)..(4150): n is a, c, g, or t
  misc_feature (4173)..(4173): n is a, c, g, or t
  misc_feature (4194)..(4194): n is a, c, g, or t
  misc_feature (4204)..(4204): n is a, c, g, or t
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacanctctggccctccacctcatggggcctcatagccctgcnggcccagcaggtcgtcccctcanccctgtcattaaagcgtcttntagctttggntccgttttt

SEQ ID NO: 346450 - DNA, 1740 bp, Homo sapiens
ccggtggccgttacgcgcgacatgccgcatagtatgtggacagcccaaatgatggaatccagaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactcgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcgatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacattta

SEQ ID NO: 346451 - DNA, 3407 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagagtaaatataccttttaataaacgtagaatgttcctggtcgggcacagtggctcacacctgtaatcccagcactttgggaagcctaaggtgggaggattgcttgggcccaaaagttggagaccaacctagacaacaaaacaagatcccgtctctacaaaaaaaaaagtagtcagaagtggtatgcatctgtaggaccagctgttggagaggctgaggcgagagggttgtttgcatcctggagtttaagactgcagtgagctatgatcgcaccactgtacaccagcctgggtgatagagtgagaccctgcctctttaaaaaagcaa

SEQ ID NO: 346452 - DNA, 4101 bp, Homo sapiens
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggtaaataaaagatgttcttttattcatttgcctgccaatccaaaaatacaaatatagttaattgtacataggaaggtattacttgttcagagttttgagtgtgtgaattacatatatgaacatctgagaaaatcctataagcagtttaatcaactgttccactccactccaagtgagtccataggcagaattgagttatggggagagcggcctagtaataattggtttgcgtaatacaaagttctactgggtagtgatgttgtagaagttcatatagaatcagctgagctttcagaaatggtgaaagggtggtaatagtcataacttagattgtaatttttttcccataggcttttaaaaaatattcatgaggttctttttttatttcaatagtttttggggaacaggtggtttttggttacatgaataagttcttcagtggtgatttctgagattttggtgcacctgtcatgtgagcagtatgaactctactttatgtgtagtcttatccctcatgtgtatgaactccaccttatgtgtagtcttatccctcacccactcctgcccttccccacaagtccccaaagtccattatatgatctttatgcctttacatcttcacagtttagctctcacacaacttattataatttataagtaagccagcattggatatagttgtattccattattaatttaagaaaccttatgcaagtaattattagtcatcatcccaaaaaaaagggagaacagggttagattcagaatactttgataagagctaaatactatcatgagtgctgtcagtctgtagtaactttccattggtattctatgtcttttaggcttacagatactttttacactcttacaaaatgttgcacaagaagaagctgcagctcagagtttttatcaaacttatttttgtgatattctccagcatatcttttctgttgtgacagacacttcacatactgctggtaagaatttaatacgatttaaatgttaagtgccagctgggcacagggcctcacgcctataatcccagcactttgggaggtcgaggcggggagattatgaggtcaggagttcgagaacagcctggccaccatggtgaaactgtctgtactaaaaataccataaaaaaataaaagatacaataaaaatactgggcatggtggcatgtgattgcaatcccacctattcgggaggctgaggcaggagaatggcttggaccgaggaggcagaggttgcagtgaactaagattgcgccacggcattccagcttgggtgacagagcgagactccgtcta

SEQ ID NO: 346453 - DNA, 2478 bp, Homo sapiens
  misc_feature (2430)..(2430): n is a, c, g, or t
  misc_feature (2478)..(2478): n is a, c, g, or t
cacgaggctgaaacccaccttgattcgtcccctctcccccctccccaccttccctcgccctaatcccccaacgaggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagaacacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatgcccttnaaatttggtcccccttgtggatcagtctatggtttcaaaaaaggcccn

SEQ ID NO: 346454 - DNA, 4363 bp, Homo sapiens
ggcgcgcgaggagggtggctgcctctggagcaggccgggagaagagaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccgagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacatgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagaggtgccctttagcttactatggttgtacctattctcagcgtagattttgtccatcaatacaaggagcaaagattatacatgaccgccaattgaggtcatttggagttcagccatgtgtatctacagtattagtggagcctgctagaaactgtgtgttgggattacataatgaccatctaagtagtcttccttttgaggtcctgcagcatattgcaggctttctcgatggcttcagcttatgtcagctctcatgtgtatccaagttaatgagggatgtgtgtggcagcctgcttcagtctcgtggcatggtcatactgcagtgggggaaaaggaagtatccagaaggaaattcatcatggcagataaaagaaaaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatgttttctttgtgaaacatttgttcaagttctaataaaattaatgttttcccttaac

SEQ ID NO: 346455 - DNA, 2354 bp, Homo sapiens
ctactcaggaggctgtggcaggaggatcacttggggccaggagttcaaggctgcagtaggctataatcaccttactgtactctagcctgggcaacagagtgagacctccatctctaaaaaaataaagccaagtgggatgtgtgtggcagcctgcttcagtctcgtggcatggtcatactgcagtgggggaaaaggaagtatccagaaggaaattcatcatggcagataaaagaaaaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatgttttctttgtgaaacatttgttcaagttctaataaaattaatgttttcccttaac

SEQ ID NO: 346456 - DNA, 4372 bp, Homo sapiens
ggcgcgcgaggagggtggctgcctctggagcaggccgggagaagagaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccgagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacatgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagaggtgccctttagcttactatggttgtacctattctcagcgtagattttgtccatcaatacaaggagcaaagattatacatgaccgccaattgaggtcatttggagttcagccatgtgtatctacagtattagtggagcctgctagaaactgtgtgttgggattacataatgaccatctaagtagtcttccttttgaggtcctgcagcatattgcaggctttctcgatggcttcagcttatgtcagctctcatgtgtatccaagttaatgagggatgtgtgtggcagcctgcttcagtctcgtggcatggtcatactgcagtgggggaaaaggaagtatccagaaggaaattcatcatggcagataaaagaaaaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatatggctcaataacttaaaaacgttcatttaaataaaattttaatacttgtttgacaaattcaaca

SEQ ID NO: 346457 - DNA, 4428 bp, Homo sapiens
ggcgcgcgaggagggtggctgcctctggagcaggccgggagaagagaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccgagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacatgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagaggtgccctttagcttactatggttgtacctattctcagcgtagattttgtccatcaatacaaggagcaaagattatacatgaccgccaattgaggtcatttggagttcagccatgtgtatctacagtattagtggagcctgctagaaactgtgtgttgggattacataatgaccatctaagtagtcttccttttgaggtcctgcagcatattgcaggctttctcgatggcttcagcttatgtcagctctcatgtgtatccaagttaatgagggatgtgtgtggcagcctgcttcagtctcgtggcatggtcatactgcagtgggggaaaaggaagtatccagaaggaaattcatcatggcagataaaagaaaaggtatggcgatttagtactgcattttgttctgttaatgaatggaaatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatgttttctttgtgaaacatttgttcaagttctaataaaattaatgttttcccttaacatggctcaataacttaaaaacgttcatttaaataaaattttaatacttgtttgacaaattcaaca

SEQ ID NO: 346458 - DNA, 4319 bp, Homo sapiens
ggcgcgcgaggagggtggctgcctctggagcaggccgggagaagagaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccgagctggactggccattatggaggaggagctgcagcattcccattgtgtgaattgtgtcagtagacggtgcatgaccaggccagagccagggatttcctgtgatttgattggttgtccattggtttgtggtgcagttttccattcttgtaaagctgatgagcatcgacttttatgtccatttgaacgagtgccttgcttaaatagtgactttggatgtccatttaccatggcccgaaataaagttgctgaacatctagaaatgtgtcctgcaagtgtggtgtgctgtactatggaatggaatcgatggccagttagttatgcagaccggaaatcatatgaaaatctaagcagagatgtcgatgaagtggcacaattggatatggccttggctcttcaagaccaaaggatgctcttagaatccctcaaagtagccaccatgatgtcaaaagcaactgataaagtatccaaacctagagaacaaatctcagttaaatcaagtgtcccagaaataccacatgctaatggtttagtgtctgttgatgaagaatcttatggtgcactttatcaagctactgtagaaacaaccagaagtttggctgctgctttggatatcctgaatactgctacaagagacattggcatgttaaatacaagtgtcccaaatgacatggatgaacagcaaaatgcgagagaaagcttagaggatcaaaacttgaaagaccaagatcatctttatgaggaggaaataggagcagtaggtggaattgactacaatgacacaaatcagaatgcccagtctgaacaaaatggttcaagtgatttattatgtgacttgaatacaagttcttatgacacttctgctctttgtaatggctttcctttggaaaatatatgtacccaggtcatagaccagaatcagaatttacatggtgattcaaaacaaagtaacttaacaaatggagactgtgtggcatcatcagatggcacttcaaaaccttccagctcacttgcggtggcagcacaacttagggaaataataccatccagtgctttgcctaatggcacagttcagcatatcctcatgccagatgatgaaggtgaaggtgaattgtgttggaaaaaagtagacttaggggacatgaagaatgtggatgtcttatctttcagtcatgctccttcattcaattttctttctaattcatgttggtctaaaccaaaggaagataaagcagtagatacatcagatttggaagttgcagaagatcctatgggcctccaaggaatagatctgatcacagcagcattgcttttttgtctaggagattctccaggagggaggggtatatctgatagccgcatggctgatatttatcacattgacgttgggactcagactttttcacttccatctgcaatattagctacaagtacaatggttggggagatagcttcagcttcagcttgtgatcatgccaatccacagctttcaaatccaagtccgtttcagacacttgggctggatttagtattggaatgtgtcgctaggtaccaacccaagcagcgttcaatgtttacctttgtgtgtggacagttatttagaaggaaagaattttcttcccactttaagaatgtgcatggtgacattcatgctggactcaatggctggatggaacagaggtgccctttagcttactatggttgtacctattctcagcgtagattttgtccatcaatacaaggagcaaagattatacatgaccgccaattgaggtcatttggagttcagccatgtgtatctacagtattagtggagcctgctagaaactgtgtgttgggattacataatgaccatctaagtagtcttccttttgaggtcctgcagcatattgcaggctttctcgatggcttcagcttatgtcagctctcatgtgtatccaagttaatgagggatgtgtgtggcagcctgcttcagtctcgtggcatggtcatactgcagtgggggaaaaggaagtatccagaaggaaattcatcatggcagataaaagaaaagatttgctgacatcctaagcatggcagaccacttgaagaaatgcagttacaatgttgtcgagaaacgggaggaagcaatccctttgccatgtatgtgtgtgacacgagaactcactaaagaaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctgaatttgttaagcactgccataatatcattataatgtttttgtcttttagtgcttccctatacaattgttaatgcacaaatgatctctaatatatacttacatacgtaaaatcataaagtttggtaatgcagtttatcgttttaaaaataatccacaaagatgtttttatctcacatacttacaactcaacacacagagtgaccatgtgcagctttcttttttgttagatgccacatccgaagactcatcgcagtgtgttatatgacaggacaaagcaaaaacaaacaaaaagcaagcctgtgaatataatttaatttgaaactgctcctggtattatatatttgctagttatctaatgttttaaaagaaaatatacctcatttaggtttgaattgggcgtattgtgtaaatttcaaatattcagaatgcaaagggcttgactattaaatgtttgcctttgatgtttataaacattacaactatgttgttttaagacatttaaaaacgtgaaatttgttatctttgtaaaatgacaatcatgtagaaacctgtcttggttgacaatctctttgaaacatttccgagttaatttcccataggcttcaccaccaagaaagtaagaattgcatctttacataatgatcaaggtataatggaaaaatatacctattcttgaagtagtttattatagttttcaaattgatttataccattattaacctgatgtggtctgcttaaaaaatgaatatatcagtatttagaaataaattgcaaaggtgggaatatatacttaaataatttgtcttaagtaaattagcatttggtagtctgaaatggtgacagattacttgttaaaattgtgaaaactctgttgtgtcctctcttcctacatttgtccctgagagtactccacgattactaggttcttgattcccttatatggcaatcaggcagaggcgttccttaagcattagagagttctgaagcttaagatttgttttggttggatgaagtccttagtacagttgaaaaacagagcattaaagactaatcaattgttttgcctcaccagtcattttaaatagtagaatacttatttctcagtgcttaaaatttctttttcaactgtgagattgaataaacagtctctatttctgtggaaaaaacaacagaaaagagatattaaataccataaaatgtaactctgccttttaaagttttgctgaagaatgtgtctgtggttaggatagcacaagcattaacttttgttttatagttatgctttttaaaattcattgtttttaaatttagacttcttatttccacactggattatgagatacttaacaatttttccaccttatatttcttttacacattttgctgttctcttttttgttattgttatgccaccataccattttgttaaaatgttttctttgtgaaacatttgttcaagttctaataaaattaatgttttcccttaac

SEQ ID NO: 346459 - DNA, 684 bp, Homo sapiens
aaataataaatatcatagtaatttagggaattgccatttctagttttacacttatgaaatatagcttaggaagtgaaagttaaatattagaacaaattctatgtcaagcaaattaagtaaacatctatgaagagactgaaaatggaatgtttttggaagtaaatagaaattgctaagcacctagcaataaagaattacaacaactcaaggaaatatgtttattagcaggatcatgaattaattgacccatttccggtacctctggtcataattggaagtaaatatgatgtttttcaggtaagctcttccgcttctagctgagtttgttgtacatatatggctgtgctttttatgagggaggtacaaaaataatatcaaaataagaaaaataattatttgaaggaatccggtttaagtcatgcatcttaaagattttggaaaagacatagttgggacagaaaaaaataggtaaagaaaataaatgcagtgattagaatggggataaggcagatttagaaaatgaatcttgccgggcacagtgcttatgccagtagtcccagcactttgggaggctgaagggggaggatcaattgagcccaggaatttgaggttacagtgagctgtaatcacaccactatactccagcctgggttacacagtgagacacttgtctcaaaaaaaaaa

SEQ ID NO: 346460 - DNA, 1397 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346461 - DNA, 676 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacgctcctggcaactatcatccctactgcctgtctctatgaatttgaccactccagtacctcatataaatgaaatcattcattatttgtccttttgttatttatttcatttagcataacgtcttcagggttcttccgtttgtagtatgtgtcaggatttccctcacttctaaggctaaataatgttccattgtgtaaacaaataccacagttcagttatccgttaatccatgcagaacatttgggttgttttca

SEQ ID NO: 346462 - DNA, 401 bp, Homo sapiens
aggattcattgatatatctaaaaaatgagaaggcagttttaaggtgcctccttgaattagtaaagttgatttttcttaaagtgatacatatttttgttttaggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346463 - DNA, 826 bp, Homo sapiens
ccccttaaggtatattttagttattcttagataaatttcagtacattaggatttcaaaatggtaattattttgagtcttttttgaaaagtgtttttatttctttaggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaattctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaa

SEQ ID NO: 346464 - DNA, 1559 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattcttaaaaaaaaaaaagaaaagaaaaaaaacattgtggggcggcgcggcccagaaaagttttaaaaccattgggggggcgggcccgggtggacatgggcagtgggtcccagagaacgggcaaaaggggggttccccaaaaaaaggcggggacgggtt

SEQ ID NO: 346465 - DNA, 1345 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacacagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346466 - DNA, 1279 bp, Homo sapiens
aacccagaaggcctcactcccagactccttgcggagctcgccgcctgattctaggctggtcactactccgagcctgtgacgtttgcggcagccaggccgtcgacgatgcccagggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346467 - DNA, 728 bp, Homo sapiens
  misc_feature (13)..(13): n is a, c, g, or t
  misc_feature (16)..(17): n is a, c, g, or t
tgctaggctgtcnccnncgcgtatggctatgtcgacccagcgctcggtaagacactggactctgtgcacattattatggagcatcattactttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346468 - DNA, 912 bp, Homo sapiens
gtgattatggtccatttgtgtgagtagctgaaatgatgagtacataaacacaagtcctttccacatcatgtactcattaagtttgaagaacgagttaaagttaccaagatttctttattcaggttttgttttgtctactcaaacagaagtatttgctgggcaacaaaacagtgattctctttgtaatctgtatttgttcaaagccatatttattttacctgtttctgtgattggaaaatagagcatgtaatttgttctcctgatttgtttaaagtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346469 - DNA, 986 bp, Homo sapiens
caaccaaaatgttacataacatttagtttgaggctggaataaaataatgataatattatactagctccctgatttcttttacttcctttcccacacttcagtagcttccctctactatcactttcttttactgatttgaaatggaattgaaaattttggtatgtatcttcttagccttgctacttctcttggttttgatttaaggtaatagggtctgtcactttttttcctataaaatgtttatttatgctatatgttaatttttgaaatcacttaaattgatagtcactcattcattcggggcaatgctctcattagtggctaaatgtaaaactagccgataatattgctgtcatatttacaggagagcgtggcagcaaatctaattgctaaactaatttagaatctttctcttctccacgtagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346470 - DNA, 1068 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggtaagctcttccgcttctagctgagtttgttgtacatatatggctgtgctttttatgagggaggtacaaaaataatatcaaaataagaaaaataattatttgaaggaatccggtttaagtcatgcatcttaaagattttggaaaagacatagttgggacagaaaaaaataggtaaagaaaataaatgcagtgattagaatggggataaggcagatttagaaaatgaatcttgccgggcacagtgcttatgccagtagtcccagcactttgggaggctgaagggggaggatcaattgagcccaggaatttgaggttacagtgagctgtaatcacaccactatactccagcctgggttacacagtgagacacttgtctcaaaaaaaaaa

SEQ ID NO: 346471 - DNA, 494 bp, Homo sapiens
tgattatggtccatttgtgtgagtagctgaaatgatgagtacataaacacaagtcctttccacatcatgtactcattaagtttgaagaacgagttaaagttaccaagatttctttattcaggttttgttttgtctactcaaacagaagtatttgctgggcaacaaaacagtgattctctttgtaatctgtatttgttcaaagccatatttattttacctgtttctgtgattggaaaatagagcatgtaatttgttctcctgatttgtttaaagtttaccagtaaatcagaagctctattactaaaaatacgtggagttatcaaccagttggcatttggcattgacaaaaggtactgctaagatattttttatatcatttattgagtgattgatttagccaatgttgtctcatctgattattgttctactcagtctcttgtgtcttgaccaggaaagtgacccagatggcttttcttaaagggataatttctttt

SEQ ID NO: 346472 - DNA, 1145 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgtgagttgctgtttgggattattactggaatccttagtcccatttatagttaatgataacatcacaaacaattctttagatttttatgcatgacttgaaattcatttgatgtagatgaacctgttcactggaaaattacagcaatttattaaaacctcagtaagagcaaaacaaggaagaagattccttatatcttcttgttagacatcttctgtgattgttatggcatattacaccaatcagagaaatagagttttaaagtagtggtttgatattgattttataatctctgtaaaaatgaagataaaaagccagattgtacaaaagtcacctgacaaagactagatgaagctacaactttaagcaaggggtagagttgtaatagccttcaccatcactctgtattttacattcatttcgtttctgtcacttattcagtatctttttatcatctgacagctaattaaattataaagttgctatgatggtaacacaagttcttcaaatacaataataaatatcatcatctggaa

SEQ ID NO: 346473 - DNA, 1407 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattctta

SEQ ID NO: 346474 - DNA, 2062 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggtattatcctaaacatttacttaatttcatctgaaattttaacacaaaacctggggtgccttgggaattccttacatttttctctatgtatttacttagagtatcttctttactattaaaattatttaagtagtacatctatttaaataacacactaatagtatactgtagaaaaaataaaaatttgatatgaataaagaaaaatttttaaatcacctgtcatcccaccacccagacatgacttagtgttcacataaacctttttgattttccagttttcattatattaaagatgagtggtgattcttaccttgctgctggagagacattttcttaatagtctttggtttgtggaattacatgaagagctttgtttttgattaggacattcagacatacctatactttccttgtactagaaaacgtatcttgcccagttaaggactgaaagcacgatctgaaagcacacagacatacctgacataacccaggttctctcaggaaaatgcttaaaagtggacaccaccatcccatgtatcactagatagccccatttgaacacacaagtctgatgtaagaatgttaagagttggcaaattcaccatcactcaaatacttagatttttcttttctttttctttttcttttttttttaagacgagtctcacactgtcgcccaggctggagtgcagtggcatgacctcggctcactacaacctccgcctcccgggttcaagcaattctctgcttcagcctcctgagtggctgggattacaggtgcctgccaccacacctggctaattttttttgcttttttagtagaaacggggtttcaccatcttggccaggctggtcttgaactcctgacctcgtgatccatccgccttggcctcccaaagtgctgggattacaggcatgagccagtgcgcctggcctagatttttctaaaaacaaacaagcaaac

SEQ ID NO: 346475 - DNA, 1343 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacattaatcagcatacccatcacaggtgacaccttacggacgttttctcttgttctcgttctggatctttcaaaacctaatgatctctggcccaccatggaaaatctcttgcaagccacaaaaagccatgtagacaaagtgataatgaaactgggaaagacaaatgctaaagcagtttctgaaatgagacagaagatctggaataatatgccgaaggatcatcctgatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346476 - DNA, 1013 bp, Homo sapiens
aaataataaatatcatagtaatttagggaattgccatttctagttttacacttatgaaatatagcttaggaagtgaaagttaaatattagaacaaattctatgtcaagcaaattaagtaaacatctatgaagagactgaaaatggaatgtttttggaagtaaatagaaattgctaagcacctagcaataaagaattacaacaactcaaggaaatatgtttattagcaggatcatgaattaattgacccatttccggtacctctggtcataattggaagtaaatatgatgtttttcaggattttgagtctgagaagagaaaggtaatatgcaagacacttcgatttgttgcacattattatggagcatcattaatgtttaccagtaaatcagaagctctattactaaaaatacgtggagttatcaaccagttggcatttggcattgacaaaagcaaatcaatatgtgtggatcagaataaaccgctgtttatcacagcaggattggattctttcggtcaaataggatctcctcctgttcctgaaaatgacattggaaagcttcatgcccactcacctatggagttgtggaaaaaagtgtatgaaaagctctttccaccaaagagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346477 - DNA, 899 bp, Homo sapiens
aacccagaaggcctcactcccagactccttgcggagctcgccgcctgattctaggctggtcactactccgagcctgtgacgtttgcggcagccaggccgtcgacgatgcccagtgaaactctctgggaaattgcaaaagctgaagtggaaaaaaggggaattaatggaagtgaaggtgatggagctgaaattgcagaaaaatttgttttcttcattggcagtaaaaatgggggaaagactactattattctaaggtgtcttgacagagatgaaccaccaaaaccaaccttagctttggaatatacatatggaagaagagcaaaagggcacaacacaccaaaagatatcgctcacttttgggaactcggtggaggaacctctttattggacttaatcagcatacccatcacaggtgacaccttacggacgttttctcttgttctcgttctggatctttcaaaacctaatgatctctggcccaccatggaaaatctcttgcaagccacaagtattaacacgctgaaagatatcaaggaccctgcgagagatcctcagtatgctgaaaatgaagtcgatgagatgagaattcagaaggatctggaactggaacagtacaaaagaagttcttccaagtcttggaaacaaatcgagcttgattcttgaacctatttcaattattgtatatttatttcttcttttccaaatacaaataagattatactgtgaattaactattgtggcaatatgtgaagaaagttaaactgtataatttgttaaaggacaagctggatttcttggactagtgcatctccctgtatatcttgaagctttttaaaaggaaaaattattgtagaaccacgtgtaattttttttaaaataaaagaatcttctactaccta

SEQ ID NO: 346478 - DNA, 2753 bp, Homo sapiens
gaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaa

SEQ ID NO: 346479 - DNA, 832 bp, Homo sapiens
aaggttttcagtgtatcaaagggacacctgcacccccatgtttattgcagcaatattcacaatagccttgtagttttagcgcttagaggcatttaaacagcctctctcctccagactacttcactgtagtttattatccctgaccctccacaatgtgattaccaaccgctaggatgagttgcatcttattataaagtagcaaattacaagattgtaacattagactttttaagaaaatccagtcagcttttatactaatccatcttaatttctaggttactcagaattccaggtattctgatttggactcacatctcgtattgtattgcctgtatttaactaggaagttactgccaacagcatctatctctattaaatgtagaggaattgacaaaagaggggaaagaaagttgttaggtaatagaactgcttcagaaatagggctattcatgtttgaagtgtttctccttcgtttttcagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacagtaggtcttggcttgttagattcctcatatgattgtcaaccggtgaaagaaatcctgtcaaattagttccaggaagggtttctttcaccggttgacaatc

SEQ ID NO: 346480 - DNA, 3106 bp, Homo sapiens
  misc_feature (3106)..(3106): n is a, c, g, or t
gaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaaaaaaaaaaaaaaaaaaaaaaaaaaaaaaaaaaaaaaaaaaaaaaaaaaggggggggcgcaaaaagatacagccacggagagggccccacagatgagaggctcccacacgcagttcttcggtcacaaagagggcccccaatcataggcgactcaatgaacaaacgcaagcaccgaggccgcagcttaacaaaacgacggcaacagtgggaaaaacaaggaagccgggggacacactccggaaaagagcaaacccccaactgagacggacaacaactgggagcagaccaccccagcacaagaagtgagagcccacgcggaatagaacagatctcgggctacaaggcgtgaacaan

SEQ ID NO: 346481 - DNA, 2025 bp, Homo sapiens
gaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaacttcccgggccagcatccaccacatcaaacccactgagcactgggatacaggatccagctcacccgctccccaaccacagtcagga

SEQ ID NO: 346482 - DNA, 1083 bp, Homo sapiens
gaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggaggtaattggaactttggcttttatcctcgcaggaacatatctgcactgaccttttggtgaacaaatacaactcctttacttggatgacacag

SEQ ID NO: 346483 - DNA, 2780 bp, Homo sapiens
gaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaaaaa

SEQ ID NO: 346484 - DNA, 2268 bp, Homo sapiens
aaggttttcagtgtatcaaagggacacctgcacccccatgtttattgcagcaatattcacaatagccttgtagttttagcgcttagaggcatttaaacagcctctctcctccagactacttcactgtagtttattatccctgaccctccacaatgtgattaccaaccgctaggatgagttgcatcttattataaagtagcaaattacaagattgtaacattagactttttaagaaaatccagtcagcttttatactaatccatcttaatttctaggttactcagaattccaggtattctgatttggactcacatctcgtattgtattgcctgtatttaactaggaagttactgccaacagcatctatctctattaaatgtagaggaattgacaaaagaggggaaagaaagttgttaggtaatagaactgcttcagaaatagggctattcatgtttgaagtgtttctccttcgtttttcagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaaaaa

SEQ ID NO: 346485 - DNA, 2300 bp, Homo sapiens
gaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaaaggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaa

SEQ ID NO: 346486 - DNA, 1799 bp, Homo sapiens
  misc_feature (1644)..(1644): n is a, c, g, or t
  misc_feature (1648)..(1648): n is a, c, g, or t
gccctacgtgtgcaatctgtgcggcaagtccttccgggggagctcgcacctgattcgccatcagaagattcattctggggagaagctatagaaagaggagcccacacaaagcttgaaagcctgtgccagatggagcctttattccacgtcgcgtggtctccaagaccccacctacctccctgatgctgaatggaaaccttcccacctaagcgctcttgaacatcccactagcaggaaggccctgtgtggccctgggccaagcacgccagctctcagcaggttttctgcatggaagggaaggtggggtgatagggagggcagccagaaaagacagctggccttcagtttctccttcttgcatttgactcccaagcctacaggatttcattttgccctgtcttcacatttcccagaatctagaagaataaatgccaagagggagaaagttgaattaaacccaggaaaatatcagaagaactctttaaaacaggctgcagtctggcacttttagaagacagaaaccacactcacagtccaaagcagtagaagaaaaatgaattcaaaagtagatgtgtcagcagcaaagtagaattttctcactgcgttgggcattggtggggacaaccaaaacaggtctgcagagcaaaggcaggtctggagggtgggtcttgagattggggatgagggtggtgagcccctgggcgtggcctcttaaccctctccttagccctagggcagtttccctcagacagctctgttacaggaggatagagatttgatcctgttggccagaggatgtttgacacccagccgtgactcagcctggacaccggacatgactgccctccaggaataacccctccctgagacatagtgtccccaagaccacagtgtgccttggacatcagcagggcctgggtctggtctgttctggcaatgatgcagccctcctgccccagtgtcaggggacctgggaagctgggtggcttgttggaggaggctgtgttctaatcagaaggtctgggttcaagtcctagttccaccccctcctacctgggtgagcttgaacaagtcctgtaacttccccaggctccattcccccatccaagagttggggtaatgggaactggccacgtgcctctaagggttggtgccaggctgtcattcagaacacagccactgtgaaagtgctttggcaactgtgagcagtcatggtgactgaggacagagacccagagtgacccctgccccacccctgtgcatttccacggactggagagatgttcccgtctggtttctgagcagtgggacctctcattgaacagggctttctctccctccaccccttgcagcctgggctgtgtatgcctgcggatgcagtgtcccacacaaggacacttcctctaggatgccatcctgagcctcctgtagcagcagtgtcattctgcacttccacattctgtctgtcttccccgcctgccaactaggagttcacgtggggcttgtttaaacagtaccattgcttgtgtcccacctggaccagttcagtcagccccagtggtggcatgttttaaagctccccaggtgattataacttcctagtgtgcagccaggctgtgggccctgtgcttgggcttttttganatgngtgtgcctggcgcaggtgatgaggggagactagtagaaagcagaacgggtaagaatcctgtttccccggacgcgccaagtggcaacgggaaattcctcgcacgctaccggacagaaaatagctacctccaggggaaaaccgcacgagacac

SEQ ID NO: 346487 - DNA, 859 bp, Homo sapiens
gaggtggaggttgcaggtagctgtgattgtgccaccacactcctgcctgggcaagagagtgagactctcaaaaagaaaacataatagtatcatctaacacatattgtggttagtatattaaaagcactattctaagtgcttacccacattaactcttaatcttcacaaccatcccattggaatattatccatgttatatagaatgtatctgcttataaaactttacaattagattcattatttaagagaaagaagcaaagtcacaatttcactcttgaaaacagtagtaattgtcctagaaacaaacagccctttaccaaatagtttacagtggtcataggcagtaatattttgctgattttgtcctttaccctctggctctgaactcattttatcttattctatggtgagttttcagttgaattccgaccactctcttaccttctgcctgcagaaggacatcacagaacacatcactctgctgctggtgatgaagctgcagaaaagctaacctgaggaaccgggggttcctgtataggattttgggactggcaggagagcacatgttggcaagagtcttaacaaaccttctaggttttcacagatcagactcctgtaggtgagataatacatttcagaggcatggttacatctaatttgttttttgtctttgaaatggcaggggaattttgaaagtgagagataatagtatgagttgaggaaacatcagcccagaaattgtgccaaggatatctcaagaaagaaaattatcatagtggttacatgtgggagctcagagataagcctaggtttgggtcttggctctatttattagcctggctgtataatctcacacagg

SEQ ID NO: 346488 - DNA, 297 bp, Homo sapiens
aggcagaggttgcagtgagccgagactgcacgactgcactccagcctgggtgacagagcaagactccgtctcaaaaaaaaaaagagttgggcatatttgccttctgtcactgcctcaagcagtgggcacatcttttttctttttcttggtctaaaaactgaaaaatgactaaaacaaatagaaaaaaaaatagaacaagggtttattttatattctctggcattttccttagctgtgtgtatgccactcttttgtattcacccatccttatcttttcttccattatgtagacttaca

SEQ ID NO: 346489 - DNA, 1679 bp, Homo sapiens
attcagccctggaggtgccatcccgggccgcgactccgctccaggcaggacccccaacccgcccagcccgctccgccttgcgccccggacccgcggccgaccccagacccgctgcccgcttcgcgcccgaggcctgcgccccgacggacgcccgtgcccagcttgccacgcccacgcccggcgccccgaccgcggaggactccccgaggtgccggcggagggggtggctcgcggctcaggctgcccccgacgtgcccggctcaccgccccctcccctgcagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgcaggacccaagcccagctcctgcgagtgggctgcgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccagggtgctgtgcccccgtccagagctgcagctgagccccatctgaagcccagtccctcggagctgcagacagcaggtcctgcagcaacaatacctgcacggctttgcacacgtaaacctaggctggtctacacgcagtgctggtacgtcaaggagcctaaacaccctgaaattgtgaccccctgggggacagctgccagacacagctggcggcagcaccagatgctaagcgcttcagagaggaggtgtctgcccagagatgtggagcagaagctgggccctgaacacacggggccatgtctggacgagcaggggagagaggctgaactggccagaagtggcccctccgctgctggtccagtcagactgaagcccggccttgtgcctgggctgttcctgccctcatgcacaaccagcccttccacgtgcctgcctgtgggacaggagggggagcgtgggatgctgtagcccccggggttgggcaagggaaggatggtggccctccagaggtcatgaagggacctctgtggctccagctgccaaccctggagcccagaccgaggtggccatggagactccacctggatcccctgtaggaggccagggaggggaactcagcagttcaggagccaccccaaaccattctgggacagggacacccctttctaccccagggcagggcagggctgggtggggcaagatcccccagcccgactagacccacctcacctgaagggggtgagacccttgttggcagccagacaagggtggggctccacaggcagcacaggcgccccaccaccacccagtttggggacccagtgggaccaggtgcgggggcagagggtgacttaccaagagccagggagggcagcccaggcccaagtgacagcaagaacaagaaccactgccggcgtgcacaga

SEQ ID NO: 346490 - DNA, 358 bp, Homo sapiens
tccgcctcatgacttcttggctggtacttttgttctaattcgtactgagcaggaattgactacatgtagattaaaaccttccgtatgtccccaaatcccccagaacaaaaaaccaacaaaaaagctgggcgcagtggctcacgcctgtaaccagcactttttgagaggttgaggctggcagatcatgaggtcaggagttcaagaccagcctggccaacatggtgaaaccccatctctactaaaaatacaaaacttagccaggtgtggtggcacatgcctgtaatcccagctgctggagaggctgaggcaggagaatagcttgaacccaggagacagaggttgcagtgagccaagattg

SEQ ID NO: 346491 - DNA, 428 bp, Homo sapiens
aaggactttggacaacaatttctttgactgaaactggggtcagagttgcagactccctggaacatgaaaagtcaataatctagttcccaaaaggcagacaagaaactattcccaagatgaacaaatgatgagaatagaggtaaaggtgaaaatgatgctttgatgcctgaaggtacaacaaacatctcatgactatgaggggatgaaaatggataccaaggataccaagatgatggaacaaaaagaattgatttggaacatgacggcactatggattcatcgtattggacctctgtgatataattctgaacttttcatataagactaatatacccctacttgtttaatacaactgtagagttatctgctacttgcagccaaatgtaatcctaactaatataggcaataaatcatgtttttatatcact

SEQ ID NO: 346492 - DNA, 312 bp, Homo sapiens
ctccaaaatcttctgggtctcatcttgtgaacatgcagaaatagcacagtccttttgaaactgtgatcactgaaggaacaattgggggttttacttttgtttccgttaacggaggggtaaattttatttaatagaggtttggggacttgcctagagtcacacagacaattccaagactgaaacacaaacatttctgttctatccaggacactaactttcaaaattcttttaaaatatagacttcttattcatcatttagtcaaccgcctagctgtaaaggtaattttttttttggcaagagtaaattaatct

SEQ ID NO: 346493 - DNA, 501 bp, Homo sapiens
gtctacataaaatgctatattaatttttcccaatgaatattttagcatgacactaatgtatgaagttggttctcctccctcttagcaaggtactgcaacccactattgactatgttaaagtctaaaaataaagaagataataaaggtaataaaatggtgattaccttcttcaagttgcttagaagtctgaagaggcaccaactcttacaaactaaattttcactttggctgactcagtctcatttcttaattttttctttacatcaccccacctcccagccttatgcctcatcacttactacctactgatcagtttaatgggcctcagaaaggctatggaaatcctaaaatgcagagtcatttacaaacttccctcacatgagccctccaatccctatgggtgcactggaatatccattttgttggtgatttatgggttagaaagagcccttaattgcttcactagcatggacttctctgtgaccaagaaaaaataaaaaa

SEQ ID NO: 346494 - DNA, 475 bp, Homo sapiens
tacattagtgtccatattctcatgaaactcatctttgttatttaacttgttttcttgaaatctgatctattagaacaagattttccatttgagttatttcttaaatcaagtttttttctctaatgtgtttcttatttgaggatttatttttcttaaatacaacctatttatgtcttattaagacttgcctactttgggccgggcacagtggctcaggcctgtaatcccagcactttgggaggccgaggcgggcagatcatgaggtcaggagatggagaccatcctggctaacatggtgaaaccctgtctctactaaaaatacaaaaaattagccaggcgtggtggcgggcgcctgtagtcccagctactcgggaggctgatgtaggagaatggcatgaacctgggaggcagagcttacagtgagctgagatcgtgccactacagtccagcctgggtgacagagtgagactccgtc

SEQ ID NO: 346495 - DNA, 464 bp, Homo sapiens
ggctaatttttttttgtactttttttgtagagatagggtttcatcgtgttgcctaggctggtctcgaactcctgggctcaagcagtcagcccaccttggggtcccaaagtgctaagattagaggtgtgaggcactgtccccagctgaggcaacccttttcactctggtatatttcacggatcagtcattgaatgttttttctgagtggtgtcttgcattatctgccctcttttcttatcctgctaccacttggctgatatgcgggcatttgtcattttggaaaatgcgccgtcatgacttcttcctgattggactggatttatctaccattcagttgctctctttccctgggccagcctctccacctgtaaaggtcagtgggtacttcaggttctttgggtcctgtacactcgatgacataatgttacctccctcctcactgcccttcacccagctgcttgagg

SEQ ID NO: 346496 - DNA, 1583 bp, Homo sapiens
cagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaagaactgacaaaacagaccaacgaaacagaatagagagcccagaaatggacccacatagtcaaaggagcaatggcagtatttgacaaagaggcaaaggcaatacaatgaagaaaatagtctttttcaataaacagtggtaataactgaacatccacatgcaaaaaaaaaaaagagtctagacacaggtcttacacccttcacaaaaataaactcaaaataaaccagagaattaaatgtaaaactcaaaactataaaactcctagaggataacataagaaaaaatctagatcttgggtttggtgatgacttttagatacggcaccaaaggtaccaaccatgaagaaaagaactgataagccagacttcattaaaattgtctacttgtttcttaaaaattgttgtcttttgcaaaagacaatgtcaagagtatgaaaagacaagccacagatagggaggaaatatttacataagacacatctgataaagaactattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataaacccagctactcgggaggctgacgcaggagaatcacttgaacccaggtggcagaggttgcagggagccaagactgtgccactgtactgcaacctgggtgacagagcgaggctctgtctcaacagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgctggtgaaaaatgtaaaaggatagcgtcatattagaagacagtttggatgtttcctacaaaactaaacacttttaccataagatccagcaattgcactccctagtatttacagaaagtcgctgaaaacctaagtccacacaaaaacctgcacaccgatatctacagcagttttattcataattagcaaaatgtggaagcaaccacaatgt

SEQ ID NO: 346497 - DNA, 556 bp, Homo sapiens
tgcagtggtgcaatgttggctcactgcaacctctgcctcctgggttcaagagattctcgtgcctcagcctcctgagtagctgggattacaggtgcgtgccaccaagcccggctgattttttgtatttttttttagtagagacggggtttcaccatgttggccaggctggtctccaactcctggcccactctggcctcccaaagtgctgggattacaggcataagccactgtgcctggccatttttctttattcttatgtattgttttgttaagtacagatttctagtttggaaataatgtttcctcagatttctgtgagcatttattgatttccagcttccagaatttctgtggaatccagtgctattttgattcccaaccttttgtatagaacctgtttttccatttatttttggaaaccttgtgtccctttttatccttatttaatggattttggcatgaaatcttctcatttcatatgagcccttttattttatcaacttttgttctgggacattttattatattactccttttatcacttctttcttcccaa

SEQ ID NO: 346498 - DNA, 409 bp, Homo sapiens
tccatctccatggagtgtgctgcgggtgatggatgagactgttgtctatctgaatggaaacctgctttcataggaagggtggaggtgggagaggaccagtgaagggcagagctctaaaattctggcaactagagtgaatataccctttcctcctttcatccttcttcctttgctccctccctccctcgcttcctttttgctacgtctctttttggtagatcactgtagttaaccttcgttctggccaagaccaagaagggttaatggacacccggctcctgacaccttccaggtcagcttggcttgcgaacttccaacgcaggaattggaggattaccggggaaggaatgcgaggtacccgatagcctcacacctgaacacggtcgcttcaatccactgggattcattt

SEQ ID NO: 346499 - DNA, 765 bp, Homo sapiens
cataatgagtgagtggcagagaccttagaagtcaggtcccagtggctaaagtacatcctgaaaaagagagaatttaacgagacttctttttgattttcagtctgggatgattttaatacagaatgcctggattcagtaacaccagaaaaaacaatccacaggatgtttgtgttaaaaagattcagaggcagtcatctagcacagtaaatcctaaattttttagaccacatcccacagttaaagcacacattgtgtgtgcaaagcatacattgtgtatatacatgtgtattatatctatgtgttatatatacatgtggatacattctgctagattttatatatatatatatatacacacgcatagatattaatatatatatcttatagaaagaaaagttcctgaaacaatggctgtccttaccacatgagatgcagcttgacataatcttttcattataaagaatgttacaaaggataggtctgggtacagtggctcatgcctgtaatcccagcacttttggaggccaagatgggtggatcgcttcaggccaggagttcgagaccagcctggccaacatggtgaaaccctgtctctactaaaaatacaaaaattagcctggcattggcacacgcatgtagtcctaactactcgggaggctgacgtgggagaatcacttgagcctgggaggcggaagttgcagtgagctgagattgtgtcactgcactccagcctgggtgacagagtgagaccctgtctcagaaaaa

SEQ ID NO: 346500 - DNA, 494 bp, Homo sapiens
gagagaagagaagctggcgaggggatagggaggaagggaagggaggaacaaaggaagcgagactggagggagaacggattgcttgggagagagctctttcctctattcccttttccctacacccccagcaataaagctctccttaggagaatacgatcaccctcactggggcggcctgagtgagtgtgtgtgtgtgtgtgtgtgagagagagagagagcgagagaacgcgagaggagagggagagagagaaagaaagagagagggagaaagtgagaccacttggcgctgtgaggaccacaaagccttggtttcggtgttctggccatctctaaaccaggccccactttccgccatccagcctacctgcccgggctaagcaccagcctcgggggacctctggctagtccttggggtcacgcccagctccagagagggaggaggggagactacctcaacccccgcctctggtgacggtcagcagaggggacgctcc

SEQ ID NO: 346501 - DNA, 474 bp, Homo sapiens
ccccagaggtcgaggctgtagtgacccgtgattgtgccactatactccagcctgggtgacagagcgagaccctgtctcaaaaaaaaagctgaggggcgggggtggaaataacttattaacaagtcagacctacagtttcctttcttctctagtttgagtatttctagactccagatataaatatttcttctggccgagcacagtggctcacacctataatcctgacagtttgagaggctgaggcaggaggatcatttgagaacaatagttcaagaccagcctgggcaacatagtgagaccccatctctacaaaaaaatctaaaattagctgggcatggtgaggcacatctgtagtcctagctactcagaaggctgaggaagcaagatcgctagagtccaggagctcaaggttatagtgagctatggtcacgttactacactccaacctgggcaacagcgcaagaccctgtctcc

SEQ ID NO: 346502 - DNA, 292 bp, Homo sapiens
  misc_feature (44)..(44): n is a, c, g, or t
ggttttattatattagaacatataatgttgtgcggtcaccctcngccgtgcgagttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 346503 - DNA, 1111 bp, Homo sapiens
cgaacgcagcatttcagggactggatgaggagcttacggttttttacagaatcatcagtatcttggaagaaaaagaatgttaagaaataacaaaacaataattattaagtactttcttaatctcattaatggagctttctggttctggacttttattcatgggattggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtggtggagtctcgctctgtcactaggctggagtgcagtggcacgatctcggctcactgcaacctccacctcccggattcaagcgattctcctgcctcagattccgaagtagctggaattacagtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacattacagtgttgtggccaacataattacacagactggataaagaataagaacaaagaaaattcaggacaggtgccatgttcttgcacaaagtcaactttaagaaaatggttttgtgatgagccactgaatgcaacttaccttgagggttgtgaaaataaaatcagtgcatggtataatgttaatgtgttaaccttaatcggaattaactttggacttttaacttcagaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 346504 - DNA, 646 bp, Homo sapiens
attgagatgaagttttgttgtgaggcaacggtaataagataagtaactaaccaaggtttttttttaatgttcagcaactatggcatgacaaaattgattttgtcatttctgagtatggatctaaagataagcctgaagatataaccaagtggactattctgaatgccttacagaaaacattacagtgttgtggccaacataattacacagactggataaagaataagaacaaagaaaattcaggacaggtgccatgttcttgcacaaagtcaactttaagaaaatggttttgtgatgagccactgaatgcaacttaccttgagggttgtgaaaataaaatcagtgcatggtataatgttaatgtgttaaccttaatcggaattaactttggacttttaacttcagaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 346505 - DNA, 1027 bp, Homo sapiens
cgaacgcagcatttcagggactggatgaggagcttacggttttttacagaatcatcagtatcttggaagaaaaagaatgttaagaaataacaaaacaataattattaagtactttcttaatctcattaatggagctttctggttctggacttttattcatgggattggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtggtggagtctcgctctgtcactaggctggagtgcagtggcacgatctcggctcactgcaacctccacctcccggattcaagcgattctcctgcctcagattccgaagtagctggaattacagtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacattacagtgttgtggccaacataattacacagactggataaagaataagaacaaagaaaattcaggacaggtgccatgttcttgcacaaagtcaactttaagaaaatggttttgtgatgagccactgaatgcaacttaccttgaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 346506 - DNA, 990 bp, Homo sapiens
cgaacgcagcatttcagggactggatgaggagcttacggttttttacagaatcatcagtatcttggaagaaaaagaatgttaagaaataacaaaacaataattattaagtactttcttaatctcattaatggagctttctggttctggacttttattcatgggattggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtgtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacattacagtgttgtggccaacataattacacagactggataaagaataagaacaaagaaaattcaggacaggtgccatgttcttgcacaaagtcaactttaagaaaatggttttgtgatgagccactgaatgcaacttaccttgagggttgtgaaaataaaatcagtgcatggtataatgttaatgtgttaaccttaatcggaattaactttggacttttaacttcagaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 346507 - DNA, 4603 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346508 - DNA, 391 bp, Homo sapiens
ctcctagaccccatgccaataacctcccccacctgtccttcagagggacctcatccagccattcctggattggggtccctggggaaatggtatttctagggcaaggttactaatggaaactgaagagcaggtggcctcacaggctgcttcctggcctgagggattgttttttggcaagagtcagctgtgcttccaggttgactgagacttccttttcttgctggatgggagctgtacagtctgtattctgactttaattttttttcatttgcttatcaaggctggagtgtgatgaggagtgttcagccttggaaaggaaaaagtaagtagttgcagctgcttttttaatctccttgcccttgagctctgtgaaattaatgggagggtacca

SEQ ID NO: 346509 - DNA, 253 bp, Homo sapiens
ttgtgctcctggcaagctgttctggagatggccaaccaggctcatgctgcttctgggctgtagtgcttgtctccttggtcttgagaccaggcctgaccatgtagcagagataggtgtggacgtgggcttcatctcacccccagcagttacagctttgatagtccagatttgagcagtatgagtaaataatagtgtttattttaatcctggaaataagtcattggtatttataatcagattttttataaaccag

SEQ ID NO: 346510 - DNA, 4493 bp, Homo sapiens
atggaattcagcagcatctgtattgaatttaaaagtaccttgagacaggaggcgcctccgccatcccgtgccgcagaacctagatcgagctgtacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346511 - DNA, 5474 bp, Homo sapiens
acgagatatgtcatagtgcgggctgggttgtgatttcggccggggccggtctataaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacgggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346512 - DNA, 3562 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaacatcgtatgttctcaattataagagggagctaagctatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattg

SEQ ID NO: 346513 - DNA, 4818 bp, Homo sapiens
tgtatatgtgattttaaaaatgtgatgtttttataatactgcatttattctgatcattagatcttatactctcatgccaatttttaaatttctttttggcaacggggacctttttacaagtgttttatgtaaaacctgacataaagtatgaaacctgtgcttcttgggttgaagtgaggatgggaaatccagatgtcaactcctccaccactactaccagcttagcttgtctatctcctgtaacatcaccagaggacccgcaggagcctcacagtgaatggtgttcaaccacggccttatggaccagatagtgttctcttaatttagaggttgcttcactctgatgctgttcttggaatgtgctgcagaggcactatgagatattaatagtttaacaaggcttttttaatttcttcctatggtaaagctcttaggcgggtcttagagctgctgtatgaactatactcatttctgcataggtctgatcagtactctatttggcctcgcacatttacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacgggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346514 - DNA, 4367 bp, Homo sapiens
  misc_feature (19)..(19): n is a, c, g, or t
  misc_feature (25)..(25): n is a, c, g, or t
aataagctagtacgaggcnggttgnaatcggccgaggcgcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacgggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346515 - DNA, 1731 bp, Homo sapiens
gttgagtatggatacaggtgaaaagataattaccagaaccgtctcttgtactctacataaaggagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346516 - DNA, 2385 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaaactattgaaataagaaaaaagaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattg

SEQ ID NO: 346517 - DNA, 2239 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaaggtatgactggggtggggcatgagggaatttctggggtgaaagtgtcgtcactctgaatcttgttagggagttgggttatgtatttgtcaaaattcagtgaaggcatacttaagatttgtggtataactttcacctcaaaagga

SEQ ID NO: 346518 - DNA, 1707 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccagggtaagtggtgggcacaccagctagcaatgcttgtgttcttttctggaaccttattaat

SEQ ID NO: 346519 - DNA, 1490 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggacctgcccacctgcctgaatgggccccagaggggatcc

SEQ ID NO: 346520 - DNA, 765 bp, Homo sapiens
tgaggtacttgtcagaatcgcagacttctaggtcccacccagctctcatcaatcagtttagtgagggtggtgcccaggactctgattttaaacatacccctagaaagattctgatacaggtagaggtgagaagccctggtttagaagcagctcggcctcccttcatggtgggaccagggccagcagggaatgtcagggccacccctgaccttcactgtgactctgctgcagagggtggcctggaggagatggtggaggagctcaacagcgggaaggtgatgtacgccttctgcagagtgaaggaccccaactctggactgcccaaatttgtcctcatcaactggacaggcgagggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattg

SEQ ID NO: 346521 - DNA, 592 bp, Homo sapiens
  misc_feature (293)..(293): n is a, c, g, or t
  misc_feature (298)..(298): n is a, c, g, or t
  misc_feature (301)..(302): n is a, c, g, or t
  misc_feature (305)..(305): n is a, c, g, or t
  misc_feature (321)..(321): n is a, c, g, or t
  misc_feature (355)..(355): n is a, c, g, or t
  misc_feature (358)..(358): n is a, c, g, or t
  misc_feature (372)..(372): n is a, c, g, or t
  misc_feature (377)..(377): n is a, c, g, or t
  misc_feature (406)..(406): n is a, c, g, or t
  misc_feature (430)..(430): n is a, c, g, or t
  misc_feature (446)..(446): n is a, c, g, or t
  misc_feature (476)..(476): n is a, c, g, or t
  misc_feature (509)..(509): n is a, c, g, or t
  misc_feature (515)..(515): n is a, c, g, or t
  misc_feature (522)..(522): n is a, c, g, or t
  misc_feature (545)..(545): n is a, c, g, or t
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatcggggagggnggganggnnagnggggggggaggggagnagggggggggggggggggagaggggggggccggnggnaaggggagagggcngagcngggaggggagggggggggggcgagagcgnggggcagcggaggagaggggcggngggagggagggggggngggggggggagagggggcgagggggggtgngggggggggagggggggcgggggggggggggcngggggngaggggngggggggggcgggggagggggcngggggggggggggcaggagaaggggggggcccgggaggggggggggc

SEQ ID NO: 346522 - DNA, 316 bp, Homo sapiens
aggtgaaaagataattaccagaaccgtctcttgtactctacataaaggtgaaacctctatcctaatttctctttagattagtttttgaactttatgtaagtgatgaaatcatgtagtttgtattatttttgtctggcttctttcgttatatttttgtgacattcactcctgttgttgcatgtagcaatgctttattcatttttattcctgcatgattttttttgtattactattcatttacccattatactgttaatggatatctttgtattaactgttagactattacaaataaaactgttaagaattctttttt

SEQ ID NO: 346523 - DNA, 568 bp, Homo sapiens
aatagtttaacaaggcttttttaatttcttcctatggtaaagctcttaggcgggtcttagagctgctgtatgaactatactcatttctgcataggtctgatcagtactctatttggcctcgcacatttacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaagtaaggttttacgttttcttcagttgaactaaagctgcactttatgcaacaattatgtaatagtgtgttttcttaacagggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagt

SEQ ID NO: 346524 - DNA, 433 bp, Homo sapiens
taacattgaaattattaccactacttcaatattgtgtcttcctatagatttaaatttttttaattacatgtagcttttggaagaaaatttatttggcctactcccatttttcctgacagatggccagagtggttggaggtgccctgcctgtcagaatgtttctgcacatgttcctaatacctacacttgtttctgtggtaagtttgtttatatacactggagtctcttttactacatacattgtacctcagttcaggaaaggtggtctgcggggcatgttttagaagttactaatgagacttcaaagctctaggagtctataagactgtaattatgtggtccatcacacagctagagccacagcctttgtgctcctggcaagctgttctggagatggccaaccaggctcatgctgcttctgggctgtagtgct

SEQ ID NO: 346525 - DNA, 426 bp, Homo sapiens
aattgagaaaataagaattggaggagggagacataggaaaaagtgagggaaatgaagttagagaaaggcttagtgggttttgaggggagagttaggggccgcagtgttagtttggttgtccaacaggaacttttacactgatgctgtctttacatctattgtctttacaggcgcacacagttcgctgtggtcaggctgtctcagtccactgttctaacccatgtgagaatattttgaactgtggtcagcaccagtgtgctgagctgtgccatgggggtcagtgccagccttgccagatcattttgaaccagggtaagtggtgggcacaccagctagcaatgcttgtgttcttttctggaaccttattaatgattgtcttgataaactttgattggtgtcagacttttagtcacaaagaccttgagt

SEQ ID NO: 346526 - DNA, 5838 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacgggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346527 - DNA, 5774 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaagagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacgggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346528 - DNA, 5435 bp, Homo sapiens
atgagtcatcttagaagactagacacttgttcctggattgttttcaatgtttaaactttatttaagaattatcagagcttgtttaggagtttcatagaaactaaacattccagccagaccactttataagcacactaatgttttacagcaaattctgttacccatctgattaattagtcttggctctgattggcttttgattcccaaagggttgtaatttgccacctagaatatacccctcctactccaaaaacagttgtcgtagaagttcccaaaatgttttaagtagtggtatttctgtaccactgtgtaatttgccaaagtgtctgctttgaagagggcagtatatatttgaatatacaaattccgtattgtaacttttttctattggtctctataatatagctcctaaaatagcatttttcagagggctaattctgacctatagcatatcactcagcccagttctttccatgacccccttccctttcattctctccatgttactcactagcatgcctcccctcatgtcagccttcttttcactgttccattgtttgcccagtgcctgattattacttcactagctgatagtatgtctgtacttcttacggaccaggtagatttgagttctattactttgcttagactctgatcttctacaggaccctattagccattctgccttttacctgagtagcaaactatttttatccccacacactgctgtaagtgggccaagactgtatttgaaaatgtcatctttgactctcagacccaaatataaccagtattttgacttgggatttacttctgtggttaaatagtctgtggtgataatgatgtcgattttttgcacataaaagtacagttgatatctttgttcaaatagtttaatcaactttaaacaaatacaaagacatgtcatagtagatgtatttgttgccatattcacaataagacccagctgggacagctttgttcgggtttggatacatggctgtggtttattcagtgaaacctttctctttcagtctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacgggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346529 - DNA, 1818 bp, Homo sapiens
  misc_feature (19)..(19): n is a, c, g, or t
  misc_feature (25)..(25): n is a, c, g, or t
aataagctagtacgaggcnggttgnaatcggccgaggcagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 346530 - DNA, 2627 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggtaagtggacttattaggcataatcagattccattcatccaggtgctgggcttctggaagcctgagccatgtggagaatgcagcccggatttaaaagtcactgggacaggcccctaagcagcagtcagagagctctcatagtccccataacctctctgcaaagagacagactgggcctttttagcctcacccaggttaagaagtcagccagtggcatctggtagcaacacagaggaagagaaagagataagagaaggtctcacaccccagagcccaagacccctagatgagcacacagtcttcggcagaagattgtgtgttgtcccaacacaaactggcctggacttagcaacttgggcttcaggtttcatgtactgcttaggtcaggtcagtaggaaaaattattaggacattttttaaaaagattttttaaaataaaatatttatttaa

SEQ ID NO: 346531 - DNA, 1490 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggacctgcctctatgtcgttttcgggaacctctagagcac

SEQ ID NO: 346532 - DNA, 1590 bp, Homo sapiens
acgtgacctggtgacagtgctggcttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattg

SEQ ID NO: 346533 - DNA, 452 bp, Homo sapiens
caaatatgatggaagtttatttctcacccctcagtccaggagaatgtcttagatgttagggtggctttcctcctcagagtcattaagggacccgggctctttctagcttatttgtccactaactcccagagcattgtcctcttctgaattgtcaaagttggtgggtgacaagtactgtctgttgccagtggggggtggaaaatatggaggaagcacatcttaagggccccagctcagaagttctacctgttacttccggtcacattctattggagagaacttaatcacatagcttcatctgcaagagaggctggcaagtgtggtctaaccgtataccatcctatgtaaagctttaggaagagtgcttgacacatagtaaacacctgcttttgtcatcgataatagtttattattattatttttttttgagacggagtctcgctctgtcgcca

SEQ ID NO: 346534 - DNA, 420 bp, Homo sapiens
ctgcagattgtctcattcggggaagctccagggttctcaagcggaattcgtgtttcattttgtgtagcacccgtcagaaagacaagccaggcatgaggatccatgatgagcgctcttctgagttgccatttggagctgcccgtttagaaagcaaatctgcatttccctcattcctagtttccttcatcctcttttaagtgtcatcttttccatgaagcctactagatcacacagttgaaaattgcaaagtcttcacaccgcagcttcccctttctttgttgctttggttttctccgtgggacttcccaccatccgtaaaattaggtgtttttgcctgttttattcactgctacgtctccaatggttagaacctgacatttagtgggtgctcaataatatttgttgaagtaatgtataata

SEQ ID NO: 346535 - DNA, 148 bp, Homo sapiens
ggcttttgcttctacagttctacacagtctatgctgttcttttttggttttgtattttatacataatctgcttactttgtactgtggaagaataggattgagccctctaattccactaaccccctccacacccctttccccttctgtc

SEQ ID NO: 346536 - DNA, 340 bp, Homo sapiens
acaaagtccatgttacacttaggttaaaaagaagaatgaaaacccctcaagccagattttatgactttttatatcacactgaaaagtccaatgaactacagatttcaaccatggagatttgtgccctactatgaaacggtaactgtaacacagattgatgaaagattctgcaggacgacaaaggttaaagatgtagacccggagctagaagccagcactgacactgatggagtggactgcgatgagaatgcccacgttattgtcctatcctctgataaccaatgtaatatgaaaaccgactacagaagaaaggaacaaattaaatccattaatcaagcat

SEQ ID NO: 346537 - DNA, 451 bp, Homo sapiens
acaaagtccatgttacacttaggttaaaaagaagaatgaaaacccctcaagccagattttatgactttttatatcacactgaaaagtccaatgaactacagatttcaaccatggagatttgtgccctactatgaaacggtaactgtaacacagattgatgaaagattctgcaggacgacaaaggttaaagatgtagacccggagctagaagccagcactgacactgatggagtggactgcgatgagaatgcccacgttattgtcctatcctctgataaccaatgtaatatgaaaaccgactacagaagaaaggaacaaattaaatccattaatcaagcatatctctgctaaacagttgttcgaaactgatgaacaaatgaaaaatttactgtttgttttcatgcttgcaaggattggggaagaaaattaattataaggtactggccacact

SEQ ID NO: 346538 - DNA, 151 bp, Homo sapiens
caatgcatcttcttatacttgtgtaattagggaacacatctattggatatctcttctcgtatcagagaactcttgaaataagtcaggctttctaagttctgcttttattgccagagttgttgccttatacctttgaaatatagtgaagtca

SEQ ID NO: 346539 - DNA, 1365 bp, Homo sapiens
tctggagagtgaagagggcaaagatctacaaggagctcagatttgtgctctagagggatgtgtgttaaggggcaagttgatgacttgggagcagaaggattcatttaaatattattcagacaacagaatgtgtgcatgggtttgtcttcacagaagttatcattatcactctccatctgttacctaaagattaatcttcggattagatctggtctacaagtatcaaaatggaggtcatcaaaatgtaattctgctggactggagaaaggtgaaactcaagcacctgctgcatggttagctaacctgtagcaagagaatcagtgaaaactgaataaatattctaaggaccaatctcaagaaacaatttgtttcagtacacataagaaaacaaagagtaatatgacacattcttacccattaggagtgtagcatttattcaacaaacatttatgaagtgcctcctctatgcaaagtatgcaggggataagaggccaagaaggtcccttccctcaaggacctcacactctacacagagacagctctaaacaactaactacaataaaatatagagagggaagtgcaatcagtgcatcttcacataaaacagtctttctatggcttgcataatgcaatgcttggatataaatctcttttaaagctaaagcaacaggcagtctgcttccaaggagacagaattttaatactattagtatcaaagggcagtttttaaatgtgtccagcccagaaagcttctaatagcacacatacaaggtctggctcaagcccctcatctccaaaaacctttctctccatttactgaatgtgtacaaaatttattagttgttccctcttatcctgacatgtcacatataacggtgtttacatagatttttttttaagtggtttcaggtattgtcattcatacttgatttataaactctttgatagaagggaccaggtatcttgtatcttgcaattcttttgattaatttacttaacggctacttattgagtgccaactctgtgcgcccaagtatcaatgtattaacagctacccaattttataaaaagggcattggggctggaaaatatgaagaactgacagctgccccaaagattccatgtgagagcctatgagcaaggagatcagaatagatagaagaaaggtatttactgtgtttctgaaatcctgtgggacatttagagtcaactctccttgtggacatatatttaattaaggtccaccctgtcaaatgaaatcgtttcagaagtttaaaaagtaaagttagtgtaacatgaagcagcaatcaatattgttctcagaattccaataacataatttgcaacttttaactctgagatatt

SEQ ID NO: 346540 - DNA, 293 bp, Homo sapiens
gttgtctaggctggtctcgaactcctggcttcaagtgattttcctacctcagcctcccaattagctgggactacaggtgtgggccaccatgcctgttgcatttgaaagctaaccctactgtaataagcatcatgaagaaaggattgaagaggaagagaaaggttacacgtgagaagaccagttaggtggtaggtacatgacacataatagaaaatcacaattaaatgccaacactagctaatcctactaaaaaagtaatccattatggatatttttaaaggttattgaatatt

SEQ ID NO: 346541 - DNA, 573 bp, Homo sapiens
tcattctttttacccttgccggctggtttcatagcttccctgggttctctcttgccttgttctcaggcacttccttgatctctttctctctcttcccagccttctggtcccttctggtctcaaatcccggaaacaacaacaacacaaatattttcagtccttcctgcatccctaccctgaactggccttcacagccccagcctggcttttgccccacccaggtgttcctgggggagagggggaaggccaatttaggatcaaaagaggcttcactttgggaccagtgcccacttggggatgacaatgaaattggtttggataagaccctgtcttcctcacattggccccacctgcaaagtctctgtgaccctagtggccttggactgagagcaaagcctcaggctgggggggcatggggaaagcagatcccacagctcctgaaactatggggaggggagcagagttcaagtaccaaattgtggttcacccttctctggctttcagcccctaaaatcttagagctttcccttaagacatctgaggaggagatttagagaactagggatttataga

SEQ ID NO: 346542 - DNA, 702 bp, Homo sapiens
aaagtgcaaaaatgtgacagataagaatttaatttactgataaaaagtaaaatagtataaaaaaagcattttgattaatactaagatagagaaaatttgactgaaaatttttggcagataataacatttttaaacgaacactttatctctttgattaaagttagcatcaggtgtaaaaaaactatcatctttttactgttattttaattatagtttattgggggactataaaatggtacattatttattttaaatactttttcttatttcagtcagatttagttaggataatgtactactttaattttttaaatttattttactcttttttcaaaaaataaaataatagcatgcagtaatagtaattatttgaaataaggtaatatgcaatagtaaatttgcagcaatttggaattatatgtgtttttcatgtttaattttgtttaaaaatcatcatagatacagttttatgggaaatatgcaaagaaaatatctcagttgataaaaactaagttgataatcatgaagatatcttgcctctgggtaaaagattcagtatacttaaaagtgctactgtttgttgttatttaatattgttttctattaaacataacttaaaaaagagaactttcaccaaaaaaaagtaaattttttcatggatgtaaattttaagtactgacatattttaaactcacgtaagtt

SEQ ID NO: 346543 - DNA, 700 bp, Homo sapiens
  misc_feature (665)..(665): n is a, c, g, or t
aaagtgcaaaaatgtgacagataagaatttaatttactgataaaaagtaaaatagtataaaaaaagcattttgattaatactaagatagagaaaatttgactgaaaatttttggcagataataacatttttaaacgaacactttatctctttgattaaagttagcatcaggtgtaaaaaaactatcatctttttactgttattttaattatagtttattgggggactataaaatggtacattatttattttaaatactttttcttatttcagtcagatttagttaggataatgtactactttaattttttaaatttattttactcttttttcaaaaaataaaataatagcatgcagtaatagtaattatttgaaataaggtaatatgcaatagtaaatttgcagcaatttggaattatatgtgtttttcatgtttaattttgtttaaaaatcatcatagatacagttttatgggaaatatgcaaagaaaatatctcagttgataaaaactaagttgataatcatgaagatatcttgcctctgggtaaaagattcagtatacttaaaagtgctactgtttgttgttatttaatattgttttctattaaaccttaccttataaaggacaccttctcccgacgtaaagctaatccgcttatcggtcgnctcttcagcacgtccatctcgttttccctcggctt

SEQ ID NO: 346544 - DNA, 910 bp, Homo sapiens
ataaataaagtcaattaattatatttgcatctgggaaatagagaaagtacatataagccatgattttgaagtcaaaagagagagaatatttggcaaggaggggtgagttatagtatgtaattataacatatagtagttttttgtatgctggtaactaattttaatttcctacatttttatgtagatttctgctattcttgtgctgttttcctaatcacctttctatatggatgactacataagtctgagaataccaaaagagacagacacagaaccaatcggattcctttcttcttgaagcttctgcacagcagaagaaactgtcaacagagtgaacagacaacctacagaataggagaaaactgttgcaacaatgcatgtgacaaagatctaatgtccaacactgataaggaacttaaacaaatttacaagaaaaaaaaaatctcattagaaagtgggcaaaggacataaacagacacttcaaaagaagacacacatgcggccaacaagcatatgaaaaaaagcccaatatcgctgatcattagagaaatgcaaatcaaaaccacaatggcataccatctcacaccagtcagaatggttattattaaaaagtcaacgccgggcatggtggctcacgcctataatcccagcacttcaggaggccaaggcaggcagatcgcatgaggtcaggagttccagaccagcctgcacaacctggcgaaaccccgtctctactaaaaatacaaaaattagcccagcgtggtggcgggcgcctgtaatcccagctactcaggatgctgaggcaggagaatcgcttgaacccgggaggcagaggttgtagtgagccgcgatcatgccactgcactctccagcttaggtgacagagcgagactctgtctcaaaaaaaaaa

SEQ ID NO: 346545 - DNA, 2521 bp, Homo sapiens
  misc_feature (1925)..(1925): n is a, c, g, or t
tccacattggggggtggggtgagactctcatcacataggcagttaggaaccccagaggctcttcagttttaaacgtgtagcttccaacgtcatcttgagaactgatattcagcagtggaaggagaaagaacagggaggatatacatttatggcttttatgtgaggcaggccttgcattggcacatacccttctgcctaaatctgattataagcagaatgcattccgatggtcacagcttactgcgggggctagcaaatgtctgcttgtttttcaaggaataggaagaaatgtttagtgaatacctagcagtctgttgccagagatggtttttgttgtttcaattccattgtacattcttcttagcatttaaaaaattatttgaacttttgaacaggcaatatcttcacatactttaaaagtttgaaaatctgaaaagttacacagtaaaatgtttgcttatcattcctgccccacatctactcagatcccactaggtaatcatggttattactttatcatgtatacttccagaaaccttttgtttaaaaaagcaaatatgaattatatatatatatatatgaaatctcttcctcccttattacatagatggagccataatatacccagtactttgtacttggctgttttcccttagtagtataagatagttattttaaattttgtattattcagtctcagtgacaaggtggcgttcccagcgtcagggaatttctaatctaatctggtcaaggtataatctactagtaaggaggaagagatacaagtagtggaagcttttgtactaaaatcaaatacttacctgttactcactctataactcaataccacatttagagcaaatgagtaatacctttataagtcaaattagatttttagaaaactgctttaggaaattaggcatgctaagataattcttggcatttaaatcacataattaagggaatagaaaatggtttgtgttaggaaatagatctttgactacatttttgcatgactttctgatgtactaagtacattttagtggtcaatgttctctacattaaatggcttttgttttggtaaacccatatgtttggagtattaatggttgtatttctaatttgttaccctggcccaaatgatgaagtaatagaatgttgcatatttccttccacttaacatttaatttgtgttaatgaaaccaaatgtcacttttaactctggaacttctaaaatgaactacaccgggaagccctctgtattctttgtggtttcccatgttccatgagccagcaaccgggtgttcacttgcagtgactctggtttactcagcccctggggatgcattactgctcggaaatgggaagggagagtagcaggtggtgcgtaattgagagctgtgtttgattgggactgacctggtgcccctttcctctgccgggttgaatgagagtttaaaggaggaactgctgctgctaagaacaaaatgaacccgagtgcctcttactgtttgtcccgactgtcagtgcatagggattaactaacatccaggaacttttagctggcctctgctttgttcttcaacattcggaccttcagtgagctctagacctgcacaaacgacctgcagcaaatggcagctttcatttgggctgaggaagaggaatattggagagaatgaggagaaggaaataaatatctttcctttttggcccttcctgctttatctttctccatctttatgcctttattaatgaggattttccaaatatcggtcttcaaaaatgccataagaagacttcattttctgtggttttaatgtcataaaatatctccttatgtgaaataactagatatgctggatcaagcataacaaacatccctttaggacattgctgaatctgtatttaaaacataagggaanaactgagggaacagatggaaaaaggaactggaaatggaagtgaattgactgctgcagctgccctctgggctcctgcagatcttggtaatcaaaaggattggggttcaactgccttgtgggagacaggagacagggtcttgggtccatttaagttagagataccatagtaacgtgagacactcaaaggactgtggtctcagtagagaggtgacaaatacgtcttgacctgttcttgcctgaggaaaacgtttctaagaattcttaaccacaggccctccctcatagattttcagtttcaatttatactctgtgtggtctggcaatttccaagctgtgaaacttatttaaaacagtctgatggtactcacataaatcaccaagttaaaaaaatgcaaaatagaataaaaaatatgagcatggaaaataaatactatcaaaagggctcagattgatttaaaaaggaaacacagacaattctttaagactgaatggactaaagaactcattcatgtaaccaaaaaccatttctgccacaaaaactattgaaattaaaaaaagaatgacttaaataagaatggatcttatactccaaaaag

SEQ ID NO: 346546 - DNA, 680 bp, Homo sapiens
aggaggattcctttgtcatgaaataatctaaataagtagttcagggaaacacacctatgtaattaaactacttcttaaataagagactggtaaacctaaatttcaggcaggtggttccctctgggtcaggcaggtgcaagagtggggaagaggcacaagggcacaggtcccctgatttcctagggtgatgggttcaaatgcatccactctgctggtacaattcatgactaacactgcctttattcttttgtatgaataaactgatacggccaaaaaattcagagacattcacacacaaacccagcctaggaccctggaaggcaaaggctctgcaaacctgcagatgtgtaggaagctattacatatagggtttggggttcgagtgtgcagctttcctacaagcagcaacaatgaatgggacctttagttacaggtttacatctccttctctaagcatccaaatgcactaattattgccataataaataacaatgacatgattatagtgtgaggcagttttttctacttttagaaccaacctatagacaaagctcaggacacttaattatagcttcagaatacattgtaaatgttgtaaaaccttactttcttaaaaaagtaatataactcttcagaatacattgttagaaaactttaattcctaaaaaatataactcttc

SEQ ID NO: 346547 - DNA, 310 bp, Homo sapiens
cgcatcttctcccatcagtagtaaaaaccagttaatttttaaccctgtgcaggaatggctgatgggagaagatgcgcccatcagggggtagccttgcttaaaaagtactgggatattagactagaaaaccttttctaggtgaatcaggtcacacacagctaaatttagtgagacacgaatcatggattaaacagttgcttcgcttatagaatgtattattttgtccaagatacacagtgtttcattggtgtgctaggcactgtacttgctgatgggacgaagactggaggatcctctagagtcacctcgc

SEQ ID NO: 346548 - DNA, 2652 bp, Homo sapiens
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaacaacttaataaaaaaagaaaacaaaaaaaaaaaaaaaaaaatttggtgggggggcctgggcccaagaaaaggtttttaaacaccattcgtgtgggggggggggaccatatggatttgggaacgtgggtcgtaggggttgcaagagaactcggggctggacaggtggtggggttttttcccaaaaaaaaaaggcgcgggcgggcgccaggcgtgtttggggcaaccctaaaaggggttgggggcggcaagggcgtcttcaaaagcgcgcgagcccgtgtactacacccgcggcggggtgggaccacaaaagaataaagagcataaaaagaacaaaacaacaaaaaagataacaaaagaaagaacgactaacgaaaaacaaaaaaacacaaaaaagacagaaagagatgagacacaacaagaaacacaacaaagacgcaattaaaacaatacaagaaa

SEQ ID NO: 346549 - DNA, 2550 bp, Homo sapiens
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatagtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaacaacttaataaaaaaagaaaacaaaaaaaaaaaaaaaaaaatttggtgggggggcctgggcccaagaaaaggtttttaaacaccattcgtgtgggggggggggaccatatggatttgggaacgtgggtcgtaggggttgcaagagaactcggggctggacaggtggtggggttttttcccaaaaaaaaaaggcgcgggcgggcgccaggcgtgtttggggcaaccctaaaaggggttgggggcggcaagggcgtcttcaaaagcgcgcgagcccgtgtactacacccgcggcggggtgggaccacaaaagaataaagagcataaaaagaacaaaacaacaaaaaagataacaaaagaaagaacgactaacgaaaaacaaaaaaacacaaaaaagacagaaagagatgagacacaacaagaaacacaacaaagacgcaattaaaacaatacaagaaa

SEQ ID NO: 346550 - DNA, 2740 bp, Homo sapiens
agtctgaattactatagatttcctgtcaatggtctttcatataaaaattatgctctccagccaggcacggtggctcatgcctgtaatcccagcacttttggaggccgaggcggctggatcgcttgagctcaggggtttgagaccagcctggccaacatggtgaaaccccatctctactaaaaatacaaaaattacccgggtgtggtggtgcatgcctgtaatcccagctacttgggagtctgaggcaggagaatcacttgaacctgggaggcagaggttgcagtgagcagagatcacaccactgcattccagcctgggccacagagtgagattctgtcgaaaataaataaataaacaatacaaatgatgctccatgaaagaagtggcagtttagcccttgacttcaggagctgcacaaggacttttgttccaggcagttgtcccgccctggaatgcagtgctgcggaagcgcgttgggcgcattctcatttgtcacacagagtattaagaagacatgtcctcgagggttgccattgaacaaaatgatgaattttcctgctttatcaagaggattttaaagcaaaactgacactttgatttttaaaagaattttagaacttgtattttctttgtgtattatttattactgcgagtgcgtgtggtagtagaggtgacaatgactcctagtacagtttggcaagaaccccgtggttcttgcccatgtctctgcagttttgcagaggcaaaactgtattttccatacaacacactgtggaaaagacaatgaatgtcttagtgttattaggacaatcatttgtccttgggggcccgcaggggtccgtggactcacttgttgagaactgccatctgccaaggccgtgcgtccatttctgagtgctgatcaatgctttgtgaccattttatctcacttaaagtgaacgagcacactccactgtttctgatgtgtccgactgatttctgtccacattactaggattccctctttctcttctttttcttctcttttagcaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaacaacttaataaaaaaagaaaacaaaaaaaaaaaaaaaaaaatttggtgggggggcctgggcccaagaaaaggtttttaaacaccattcgtgtgggggggggggaccatatggatttgggaacgtgggtcgtaggggttgcaagagaactcggggctggacaggtggtggggttttttcccaaaaaaaaaaggcgcgggcgggcgccaggcgtgtttggggcaaccctaaaaggggttgggggcggcaagggcgtcttcaaaagcgcgcgagcccgtgtactacacccgcggcggggtgggaccacaaaagaataaagagcataaaaagaacaaaacaacaaaaaagataacaaaagaaagaacgactaacgaaaaacaaaaaaacacaaaaaagacagaaagagatgagacacaacaagaaacacaacaaagacgcaattaaaacaatacaagaaa

SEQ ID NO: 346551 - DNA, 1526 bp, Homo sapiens
  misc_feature (1480)..(1480): n is a, c, g, or t
  misc_feature (1493)..(1493): n is a, c, g, or t
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccgctgtgggtaatcatgtgccaaantgctgcgtccatnggccagcaccagagtccattaccatctgtccgg

SEQ ID NO: 346552 - DNA, 1150 bp, Homo sapiens
atacaagaggcactacctaaatagttttcggagagaaccagctatttccaagtttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaacaacttaataaaaaaagaaaacaaaaaaaaaaaaaaaaaaatttggtgggggggcctgggcccaagaaaaggtttttaaacaccattcgtgtgggggggggggaccatatggatttgggaacgtgggtcgtaggggttgcaagagaactcggggctggacaggtggtggggttttttcccaaaaaaaaaaggcgcgggcgggcgccaggcgtgtttggggcaaccctaaaaggggttgggggcggcaagggcgtcttcaaaagcgcgcgagcccgtgtactacacccgcggcggggtgggaccacaaaagaataaagagcataaaaagaacaaaacaacaaaaaagataacaaaagaaagaacgactaacgaaaaacaaaaaaacacaaaaaagacagaaagagatgagacacaacaagaaacacaacaaagacgcaattaaaacaatacaagaaa

SEQ ID NO: 346553 - DNA, 1114 bp, Homo sapiens
  misc_feature (1089)..(1089): n is a, c, g, or t
  misc_feature (1098)..(1098): n is a, c, g, or t
  misc_feature (1114)..(1114): n is a, c, g, or t
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcagaggtgggtcaccaatggggccttttcccgcaactaatggccttggnttttaaccnttgggaaagtttttgn

SEQ ID NO: 346554 - DNA, 765 bp, Homo sapiens
gactgatttctgtccacattactaggattccctctttctcttctttttcttctcttttagcaaggaaatttcaacagttcccttggctcagatgggtacatgctctcggccctgacctgtgggatggctccagtaacttctattactgaggggctccagcagggtaagctctgcctaggctagcaatcagacaggccgatggacaagagaaaaactgcctttcatcaaaccttgatgagaagaggttaagggaaaactaagtaactttatttgacaatgtatttttatggagctatcaacttttcctcttcctccaccaggaatgagtaaataggttaaagatataacttcaggaatttagaatggcaagaagtcttcagtgccgggccttgcagatagagaaataaaacaccgtatctgctgttgaggtgttaacctggattttcacctaagaaccactgctccaatgtgttttgaaaatggaatactcctctagagtaaggggtagccttgcttaaaaagtactgggatattagactagaaaaccttttctaggtgaatcaggtcacacacagctaaatttagtgagacacgaatcatggattaaacagttgcttcgcttatagaatgtattattttgtccaagatacacagtgtttcattggtgtgctaggcactgtacttgctgatggggaatcagatggaaggcgacctctccagcttcaggggcttacagtcaagtggaatgcactgaccaaaaaggtg

SEQ ID NO: 346555 - DNA, 2423 bp, Homo sapiens
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagcttttaggaaaggctgatgatggtataaagtttgctcattaagaaaaaaagacaaggctgattttgaagagagttgcttttgaaataaaatgatcacctgttctttatgtgactctcccactgaacctgcagacattatttttataccacatgctaaggaagcccactcatctaactctgtagccctg

SEQ ID NO: 346556 - DNA, 2597 bp, Homo sapiens
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaattgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaacaacttaataaaaaaagaaaacaaaaaaaaaaaaaaaaaaatttggtgggggggcctgggcccaagaaaaggtttttaaacaccattcgtgtgggggggggggaccatatggatttgggaacgtgggtcgtaggggttgcaagagaactcggggctggacaggtggtggggttttttcccaaaaaaaaaaggcgcgggcgggcgccaggcgtgtttggggcaaccctaaaaggggttgggggcggcaagggcgtcttcaaaagcgcgcgagcccgtgtactacacccgcggcggggtgggaccacaaaagaataaagagcataaaaagaacaaaacaacaaaaaagataacaaaagaaagaacgactaacgaaaaacaaaaaaacacaaaaaagacagaaagagatgagacacaacaagaaacacaacaaagacgcaattaaaacaatacaagaaa

SEQ ID NO: 346557 - DNA, 2038 bp, Homo sapiens
ctcatgaggaagctgttctgaaaagctctgttttaacctttggcaatgcagccgtaaccttgagtttgagaagcactgctctgaaatcctgtcttccattagctttggagccagcatccttctttaccatgagagagaaggcagaggggcagcacagacgtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctgtctctctgtctctctgtctctctgtctctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaacaacttaataaaaaaagaaaacaaaaaaaaaaaaaaaaaaatttggtgggggggcctgggcccaagaaaaggtttttaaacaccattcgtgtgggggggggggaccatatggatttgggaacgtgggtcgtaggggttgcaagagaactcggggctggacaggtggtggggttttttcccaaaaaaaaaaggcgcgggcgggcgccaggcgtgtttggggcaaccctaaaaggggttgggggcggcaagggcgtcttcaaaagcgcgcgagcccgtgtactacacccgcggcggggtgggaccacaaaagaataaagagcataaaaagaacaaaacaacaaaaaagataacaaaagaaagaacgactaacgaaaaacaaaaaaacacaaaaaagacagaaagagatgagacacaacaagaaacacaacaaagacgcaattaaaacaatacaagaaa

SEQ ID NO: 346558 - DNA, 630 bp, Homo sapiens
agcggctcttcttcccctccgccgcggcccgccccggcccgcaaacccaaacactccaggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtaaatctctgtcttcagaatgcattttctgtataactcagcacagctgtataaaggaaaaacagagttacttcacctgtgaatagttaattgaaagcatatatgtactgttttttaaaaggtggaattgtttgaatggtctagtaactcagaatatcacacacacgcaaaatgaatagactcccacacacattcatatctacaaatggtc

SEQ ID NO: 346559 - DNA, 258 bp, Homo sapiens
ctacgaggagagggaataagatgggctgtctctttccaaaatttaaaattataaaccagactgtgatctacagagtgtatctaatacccttatcttacagatgagtttaaaaatcatctcgtgttcatggcaataaagaaaatgagattatgtgaactcaccaagacacatctatccctctctcacccagcttccacaagtattaactcgtggcaaatcttatttcacctgtactatcacctactacccattccccta

SEQ ID NO: 346560 - DNA, 492 bp, Homo sapiens
ctttcatccatcctttcatcatggggaagattaaatgggacacatggagccaggaaaggtgggtgacagctgggagaaattttcttagaggcctcagagcacttccagaggattgatttgaatccattttctgccagttcctttagctttacccaggttatcatccctgcagggagctgggagctgtatctcattgaacttctgatatgttagacaactctagaacattcttaaatttccttaagcttgattccttagttaaaaaaatagaggtaaaaatctttacctcctctatttcttctaagaacaatataaagaaaatgcatttgcatttgaaaaaaatgatttttaacttgtgagggccatttgtgttgacttagtaaattgacttccccctgagtgcagtagaaaggcacagactgactttttacagcactgaacgtttagtggtaggtggtcagtggtttatattttattatcaagaagtcaaag

SEQ ID NO: 346561 - DNA, 257 bp, Homo sapiens
gctgacaggacatccaaccctctggctatggcatcttggaggaacaggcaggccttgaaaatagcagaaattccgaattcccctgccccgggaggactcaaaggaccctgctgaggacagagctgatatggcctcagaataaagatgagggaagaccatcccaaggaagacccctctagcccatggcaaaagggctggaatacgcaaggatttgaaaagcaagttttgctttccatataaacctaagcaagtcgctt

SEQ ID NO: 346562 - DNA, 1216 bp, Homo sapiens
tgggtgacagaatgagaccctgtctcaggaaaaaagatattactcactttcatgttttccttatagcttcagctttattgttgatgagcattttcctgcatcccttgtttaaagtacctctaaatctagacataacccagatacttggatgtgctgccgccaattgaaatgatccttgattaactcctgcttattctcttgatcaatttggctgtaaaagcttctcctctgctttaacagtttttaatgctttttactttacctgagccatttaaaacattttaccatggtcttgacattaaaagcaaaactgaagaaatcttacaccagcatcatccaaagctgccctccctgtgaattatagttttagagtcattttctaagcctagaacatttagtctattttcatttcactgttagtatttacaagtgtgaatacccttcagttaaagaccactaggagtacacctgtcatagagcaggttggatttattgctcattgcagcaaagaacacagaccgcagggaaccatggggtgtcctagtaacagggtgttataatgtattataggatttgggctttggataattttggggggaaggtctaaggacatgagggcttgctctagatagggtgctgtcggaaaacagaggcaattctatgattgggtatcaacagatcttatagagggggtcaagtagattgaggttaaagctgtaattggtgaagaaatagctgtcactcattcagcaagaaagagaattttgtattttgtgggttgtacagtgacctagttttttctcactttgccatggtcttggagtgactacttttgatattgacgttcagtgagattgtccaacaggagcgtggaatgtttaagctgtacatgtcagaacagtttgtagtaacaccaaggcttagcttgaacatcagattagttctcagaggtcaggggctgctgctttttactttcttgaacatattgaaatccagacagacttgaggtcaggatttagtagcagcgacatgctcggcaggcacaggttggaaccagctgaaatgatgccagcagtatgtttttacaaaacggagcaattggggagaatttggtggcatgttaaccagcattagacaagcaggatacattataggcaaaagcagcctcttcagatagtaccactagtttgccactggcgtatagaattttcccata

SEQ ID NO: 346563 - DNA, 386 bp, Homo sapiens
gttggtatagcaaccccagagaagtgcttcattttctttttatagtagaagcaggtccatgtcttttgtggtttccttcacatctttggagtagttatgacttctcagtttttccccccttaaactgcattgcctgttctcttttcctgacatgctatcaggtatcagtgtgttgaatacatactgcttgtgtgtcaaaaaaaaaaaaaagaattaaaattttgattagctgggcatggtggcatgtgcccatagtcccagctactcaggaggctgagacaaggagggttgcttgagcctgggaggtcaaggctgcagtgagccataatcatcactgcactccagcccaggcaacagagcaagaccctgtctcaagaaaaaaaaaa

SEQ ID NO: 346564 - DNA, 475 bp, Homo sapiens
tggcatgttttgttgatgttgttgtttattttttgaaatagagtcttgctctgtcacccaggctgtagtacagaggcacaatcataggtcactgcagcctcgaccttccaagctcaagtgatcctcccacctcagcccctggagtagccaggactacaggtgcacaccatcacaccctggctaatattttaattttccatacagatgaagtctcactgtattgcctagactggtcttgaattcctgggctcaagcaatctccctgcctcaaactcccatagtattgggattacaggtgtgagccactgtgtccagcctacctggcatgtttttgacattctctaaatgtttactgatgaacaattagttgaatttcattgctaacattatcctctcctttggtgaattttagtctgtgtctgcaatcctacatcatagacttatgaatttggattaaatggattttaaaatatca

SEQ ID NO: 346565 - DNA, 413 bp, Homo sapiens
tggagtgcaatggcgcgatcttggcccactgcaacctccgcttcccgggttcaagcgattctcctacctcagcctcccgagtagctgggattacaggcgttagccaccacgccaggctaatttttgtatttttagtagagactgggtttcaccatgttggtcaggctggtcttgaactcctgatatcagatgatccgcctgcttcggcctcccaaagtgctgggattacagacgtgagccaccgcgcctggcctatttttatttttttagaggcggggtctccctatattgcctaggctggcttctaacttctaggctcaagccatccttccgcctcagtctcccgagtgggactacggtgtgcgccactgcatcccgtctggttctaaatttaggggggcctagaggatctg

SEQ ID NO: 346566 - DNA, 5340 bp, Homo sapiens
  misc_feature (1)..(1): n is a, c, g, or t
nggggaactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaaatgatggaacaagacccaaaatgacaccggaacaaatggccaaagaaatgtcagaatttttgagtagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346567 - DNA, 5244 bp, Homo sapiens
  misc_feature (1)..(1): n is a, c, g, or t
nggggaactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346568 - DNA, 3610 bp, Homo sapiens
caatttgatgactgagagtgagcaccactgaactttcttccagcgactgcatgtgagccagtgattgactcttttaaccaactctgctaagtggtcagggtcagacttcatgatctgatcaaattctgcaaacttgccaggtctaaaaaatactttggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346569 - DNA, 2970 bp, Homo sapiens
cattcacaaattattttggacttccgaacagtgattgacagtgctttgtgcttgttcgtgaatctagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346570 - DNA, 5602 bp, Homo sapiens
tccatgctgaattccttatgggtgtcaatgagagactgcagggcctctgtgtcatcaggaagtgctccccgaaagcgaagcgtttgccggaattccgggatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaataaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaac

SEQ ID NO: 346571 - DNA, 3440 bp, Homo sapiens
  misc_feature (1)..(1): n is a, c, g, or t
  misc_feature (3436)..(3436): n is a, c, g, or t
nggggaactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagtgcctgcgagaatgtgacagaccaaatgcccggacaatggcaagaatgcaaatttgatgagtctntgct

SEQ ID NO: 346572 - DNA, 5127 bp, Homo sapiens
tccatgctgaattccttatgggtgtcaatgagagactgcagggcctctgtgtcatcaggaagtgctccccgaaagcgaagcgtttgccggaattccgggatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346573 - DNA, 5337 bp, Homo sapiens
  misc_feature (1)..(1): n is a, c, g, or t
nggggaactcggcggggcgccggccggcgggcggagaccgactcgggatctgtccgagcaggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagcggttttgttttagctggagtagtccagctcgggatggctagagaggactagttgagttgagagaggaaagcaggcacagccaggggcttcagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346574 - DNA, 2847 bp, Homo sapiens
tgatgggtaaccaccctgcatcaagtccaaaacagacaccatccctgaacactgaagctgagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaa

SEQ ID NO: 346575 - DNA, 5462 bp, Homo sapiens
tccatgctgaattccttatgggtgtcaatgagagactgcagggcctctgtgtcatcaggaagtgctccccgaaagcgaagcgtttgccggaattccgggatcgtggatcctccttcaaaaatggaggatggaaagcccgtttgggcgccacaccctacagatggatttcagatgggcaatattgtggatattggccccgacagcttaacaattgaacccttgaatcagaaaggcaagacatttttggctctcataaaccaagtgtttcctgcagaagaggacagtaaaaaagatgtggaagataactgttcactaatgtatttaaatgaagccacactgctccataatatcaaagttcgatatagtaaagacagaatttatacatatgtcgccaacattctgattgcagtgaatccatactttgacatacctaaaatatattcttcagaagcaataaagtcatatcaaggaaaatctcttgggacaagaccacctcatgtctttgcaattgctgataaagcttttcgagacatgaaggtgctcaagatgagtcagtctatcattgtatctggagaatcaggagccggcaaaacagaaaatacaaaatttgttctaagatacctgactgaatcctatggaacaggtcaagatattgatgacagaattgttgaagctaacccactcctagaagcctttggaaatgcgaagactgttcgcaacaataatagcagtcgatttgggaaatttgtagaaatacattttaatgaaaagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcggtatttaaaccgaggctgcactagatactttgctaacaaagaaactgacaaacagattttacagaaccgcaaaagtcctgagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaaggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttgagtactttgagcataacagttttgaacaattttgcatcaactattgcaatgaaaaacttcaacaattttttaatgaaaggattctgaaggaggaacaagaactctatcaaaaagaaggtttaggtgttaatgaagtgcattatgtggataatcaggactgtatagatttaattgaagccaaattagtgggaatactggatattttggatgaagaaaatcgccttccccagccaagtgatcaacactttacatctgcagttcaccaaaagcacaaggatcattttcgactcactattcccagaaaatctaagctggcagttcataggaatatcagagacgacgaaggcttcattatcaggcattttgcgggggcagtgtgctatgaaacaacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaagacacagttaaatttgcttctggataaacttcgaagtactggagcaagctttattcgttgcatcaaacctaacttaaagatgacaagccaccactttgaaggtgctcaaattctgtctcagcttcagtgttcagggatggtgtctgttttggacttgatgcagggtggttacccatcacgagcttcatttcatgaactctacaacatgtacaaaaagtatatgccagataaacttgcaagattggatccaagactattttgtaaggctttgtttaaagctttgggcttaaatgaaaatgactacaagtttgggttaaccaaagtattttttagacctggcaagtttgcagaatttgatcagatcatgaagtctgaccctgaccacttagcagagttggttaaaagagtcaatcactggctcacatgcagtcgctggaagaaagttcagtggtgctcactctcagtcatcaaattgaaaaacaaaataaaatatcgagctgaagcctgcattaaaatgcaaaaaactattcgaatgtggctttgcaagaggagacacaaacctcgcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgaaacttgagatggaagcaaagagaaaacaagaagaagaagagagaaagaaaagggaagatgatgaaaaacgcattcaagctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggagaggtcctgctgtactagccaccaaagcagctgctggtactaagaaatatgatcttagtaaatggaaatatgcagaactacgtgataccatcaatacttcttgtgatattgagctcctggcagcttgcagagaagaatttcataggagactaaaagtgtatcatgcttggaaatctaagaacaagaagagaaatactgaaacagagcaacgtgctccaaagtctgttactgattatgattttgcaccatttttgaacaattcacctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaattaaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaatgtcagcagctttaagcctaatatttatgactttcacatttggaatttaaagacaaaaatacatcaaggagttatgctgacataattctaaggagttttgttgtattttagaataaaattataaagtaaaacacgacacaacaccccacaacagcaaaaaaaaactcttttggggcgccttgggccccggaaaagttttaaaacccacctgcgtgtagggccccggcggggccccatatagtgaagtgagaagacgacggggggcaaaagagcggggggtccccaaggagaaaacccgggggccgagagaacaaagcggcggagggattcctcccccaatataaaaaacgcgccgcgggggaacccagagggcggctctgaggaaaactccgagagaggggctgtggaaggacaaaaacagggggactcatacacagcggggccacggagcggagaataatgaggg

SEQ ID NO: 346576 - DNA, 329 bp, Homo sapiens
acacaagtcaatcattatttcactaagttacttctactcagctatctacttttaaatgttactttggataaaatcaggcttagtctatagatcaactggcttatatggatctttccaatgggtttggcttgataatatatagagttgtctattaacttatactatttttcaggtcaaaaaataaattctgagatgcctataagagaatgaaaattggcacaggttggctttgaagacaaaaagaagaatcttctagagctcttgactggtaacaatcagcttattaacctaaaccttttcctaatattcctcttaaaagtgtgagtttc

SEQ ID NO: 346577 - DNA, 447 bp, Homo sapiens
cctaccccagaggcaatcactgttctcattttttccaccatgtactggtttcacttgttctgcaacttcatatagttactcactatgtatccttttgtccctggctattgtgagtaaagctactaggaacattcttgttcaggtcttttcgtaaataaatttatttctctggggtaaatacctggaagaagaggtgctaagttgtatgtttaactttctaaggagccatcatactgttttctaaagtgtgccattttatatccctcttagcagtgtatgaacattttatttagtttgtatccttaccaatagttgatagtcatcttttaaattttagtcattctggtttgtgtgtggtggtatctcattgtaattttaatttgcatttccttgatgactaatagtattgtgttcttttttatgtgctcattggccatttgtgtatct

SEQ ID NO: 346578 - DNA, 473 bp, Homo sapiens
tatctcacacctgtaatcccagcactttgggaggccaaggcaggcggatgacttgaggtcaggagttcacgactagcctagccaatatggcaaaactctgtctctactgaaaatacaaaaattagccaggcatggtggcacaggcctatagtcccagctactcgggaggctgaggtggaagaatcgcttgtacctaggaagcagagggtgcagtgagccaagattgcaccactgcactccagcctggatgacagagtgagattctgtctcaataaataaataaattgtattgaatgtttactaaatttaagaaatatacaaggtgctatggtttggatatttgcctccccaaacctcatgttgaaaattgatcccaatgttggaggtggagcctaacgggaggtgattgggtcacggaggtggatccgtcatgaaaagatcaatgccctaccttgggagggggatgattgcat

SEQ ID NO: 346579 - DNA, 781 bp, Homo sapiens
tatcagaatgcctatttcatttgttaaagcaaactgaagttagccaacgaggaactctgggagggccccatttccaaaactctggttagtcatgagtaatttttgtcaggctactttgactgccaccaccacctttaaaaacatatttctgttgtttgttagttccgttgagtatatttacgtagcaatcattgttttagcaaatacatacatgttttgaatttctgttgtttaaatgtaaaatgtgatagatgttaattaaaactttcagctaatgcaatttgagataacaaagcatagtattggcttcacctactttttcttggattttaaatcctggaaaatgtcttttttgttttgttttcagttcccaaacatttctcaaattagacatagtctgaaggaagaatacattccttccacaactattgaaaaaataatactgttaaaattgagttgtgccttcagcatctcacaggattacagtatttaaaatccagaggaagctttaaagattgccttttaaactcatgtaaacttgactaggtgttctttaaggagactatgtaaaaatcagtctgtatccacaaagtgctcaccaacttaatacagacatgtacgcacaaaactgagaggaaggtacatactggagtaattttgcactcagttatttataggttgtaattctcaaaaaccagctgatcagagagggaagagacttaaaaaaatggaaaattagccactaaatagaataatcaagatgagcaatgggcaagacctg

SEQ ID NO: 346580 - DNA, 1801 bp, Homo sapiens
ttcaaatagttgtagcaagaatgaaatagacattgatgcttttaggcattatagcttttctgatcaacctaagtgttcacagtacatatctgggctcatgagtgtacatggactcctcggatgcggccgtcctgcagcagaagcctcgagagcctccgggtgggtgccaagccgcctcccttccagcggtggccgagcgacagctggatcaggtgcggcgcgcaccgggactgggacgagcccccgccacgtggaggcaggatggacggctggagtggggaccgcgcccgggcggctgcacccaccggcctccagcctccaggctgcaaggaccacggctgctcctcgggaagccctttcagggatccagcggggtcctctgtgatacgcagtggcaaaggagaccgcccggaaggcccctccttcctcaggccgccggcagtgacagtcaagaagctgcagaagtggatgtacaaagggcgtctgctgtccctgggaatgaagggtcgtgcccgtgggacggctcccaaagtcacaggaacgcaggcagcctccccaaatgtgggcgctttgaaagtgcgtgaaaaccgtgtcctgtcggtgcctccagaccaaagaattacgctgacagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggttctgggatcctggctgctacaaatagtactgaattgggaattatggaaccatcttctccaaatcctagccctgtgaaaaaaggcagttcaattaattggtcattgccagataaaataaaatctccacgaactgtgaggaaactttccatgaaaatgaaaaagttgccagaatttagccgaaagctaagcgttaagggaacattgaattatataaacagtccagataatactccttctttgtctaaatataactgccgagaaattcatcatactgatattctgccctctgggaacacaaccaccgctgctaagaggaatgttataagccgataccatcttgataccagtgtatcctcccagcagagctaccagaagaaaaactctatgagttctaagtattcctgcaaaggtggttaccttagtgatggagactcacctgaacttacaactaaagctagcaaacatggatctg

SEQ ID NO: 346581 - DNA, 747 bp, Homo sapiens
tagcttttgatgtgaggttattagatctttctctataaggaataaagtatgaaaaattaaattaaattttaaataattgggataatgcagtattctgcttgaatatcatgatggaagttgacctgaacttctaatgaaatctccccattgagatgaaataagagaagaatttctgcctatgtgaaagcctgtttagttgatggtttataaaataagaataaaagaaatcaaaacatattgctttataacgtatttttctttctttcttttaaggttctgggatcctggctgctacaaatagtactgaattgggaattatggaaccatcttctccaaatcctagccctgtgaaaaaaggcagttcaattaattggtcattgccagataaaataaaatctccacgaactgtgaggaaactttccatgaaaatgaaaaagttgccagaatttagccgaaagctaagcgttaagggaacattgaattatataaacagtccagataatactccttctttgtctaaatataactgccgagaaattcatcatactgatattctgccctctgggaacacaaccaccgctgctaagaggaatgttataagccgataccatcttgataccagtgtatcctcccagcagagctaccagaagaaaaactctatgagttctaagtattcctgcaaaggtggttaccttagtgatggagactcacctgaacttacaactaaagctagcaaacatggatctg

SEQ ID NO: 346582 - DNA, 1844 bp, Homo sapiens
gcaggctgcggacccagttgcgagaggcctattatctgctgatccaggccatgcacgacctgccccctgactcgggcgcgcggcggggcggcaggggcttggcggatcacagcttccccgcgggagcccgggctccgggccagccgccttcccgcggcgccgcgtaccgccgagcctgcccccgggacggggagcggggaggcggcggacgccctcggcagcaggtgtccccgccccggtcgcctcagagggagccgcggggaggccagctgcggactcctcggatgcggccgtcctgcagcagaagcctcgagagcctccgggtgggtgccaagccgcctcccttccagcggtggccgagcgacagctggatcaggtgcggcgcgcaccgggactgggacgagcccccgccacgtggaggcaggatggacggctggagtggggaccgcgcccgggcggctgcacccaccggcctccagcctccaggctgcaaggaccacggctgctcctcgggaagccctttcagggatccagcggggtcctctgtgatacgcagtggcaaaggagaccgcccggaaggcccctccttcctcaggccgccggcagtgacagtcaagaagctgcagaagtggatgtacaaagggcgtctgctgtccctgggaatgaagggtcgtgcccgtgggacggctcccaaagtcacaggaacgcaggcagcctccccaaatgtgggcgctttgaaagtgcgtgaaaaccgtgtcctgtcggtgcctccagaccaaagaattacgctgacaggtaggatactttgcgatgaaaatgctagcaccgcgagccttactgtttaccgactgggcttctgtcttaagagccaagaaaaagttatgtttttgcgacagacaatggcatgaagaattgaggttgtgatttcttctcgaaaaaccagtgtgtctattccctaagtattacctaaaggagtaaagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggtaaaaatgatcatatatgtgtctttctttcttcttccatttttgaattatttgataatagctaaaactaaatataaaagatgtttgttatattcatgtactttttcttgtgaagtgaatatattttcatgaaaataaaactcaaaaagttttataaacattttaacg

SEQ ID NO: 346583 - DNA, 1760 bp, Homo sapiens
gcaggctgcggacccagttgcgagaggcctattatctgctgatccaggccatgcacgacctgccccctgactcgggcgcgcggcggggcggcaggggcttggcggatcacagcttccccgcgggagcccgggctccgggccagccgccttcccgcggcgccgcgtaccgccgagcctgcccccgggacggggagcggggaggcggcggacgccctcggcagcaggtgtccccgccccggtcgcctcagagggagccgcggggaggccagctgcggactcctcggatgcggccgtcctgcagcagaagcctcgagagcctccgggtgggtgccaagccgcctcccttccagcggtggccgagcgacagctggatcaggtgcggcgcgcaccgggactgggacgagcccccgccacgtggaggcaggatggacggctggagtggggaccgcgcccgggcggctgcacccaccggcctccagcctccaggctgcaaggaccacggctgctcctcgggaagccctttcagggatccagcggggtcctctgtgatacgcagtggcaaaggagaccgcccggaaggcccctccttcctcaggccgccggcagtgacagtcaagaagctgcagaagtggatgtacaaagggcgtctgctgtccctgggaatgaagggtcgtgcccgtgggacggctcccaaagtcacaggaacgcaggcagcctccccaaatgtgggcgctttgaaagtgcgtgaaaaccgtgtcctgtcggtgcctccagaccaaagaattacgctgacaggtaggatactttgcgatgaaaatgctagcaccgcgagccttactgtttaccgactgggcttctgtcttaagagccaagaaaaagttatgtttttgcgacagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggtaaaaatgatcatatatgtgtctttctttcttcttccatttttgaattatttgataatagctaaaactaaatataaaagatgtttgttatattcatgtactttttcttgtgaagtgaatatattttcatgaaaataaaactcaaaaagttttataaacattttaacg

SEQ ID NO: 346584 - DNA, 2066 bp, Homo sapiens
  misc_feature (2029)..(2029): n is a, c, g, or t
ctcactgggggtaaaaggggttctatttgcttaaactcatgctcgtaggcaattttagggctctctggggctctgaatggtttctccaccaccacctttcttccaccaatagaaagatgttgtccttacaaggccatgtctgagaagaccatggtttaactagtaaaagaagctcacattgcagagagctgaataataccaggctcttgactttgtactgtgtgtcacagtcatgattgggacagaaggaaccagtctgctgaaaagtcaagccagcacaaatatttggaaactaattccactgaaactcttgtatcattaaatcatactattgtagtttcagttaatgtaattatttaatatcaggcactaaattaaatagctttgcacaaaattttagaaaagatcaatcttgtaacaaaatttaatattaacagtaaaaagcacctgagaaaagaaaatatcgatctgttgtggtttatatacttgagttattcttagaactttgtggagattgacacatgctctgataaaaaggaagaaaatgttttgaattcaagaatgctagactaatagaaatagcccagtctctctgggccactgctcttcagtatggggtgctctctgtccctccttagcagatggggttgtttggaggctaaaatgagctaagggaagaagctatactgtgcctccaatatcccttatgtgtaattagagtgccgatctgggctgcaggctttattcaatgattcctttcccttacttgaggctttctctgtagagctgttatttctgagcctccattctgggatttacaaaggaaacagaatgatgaagaagtaacaatcagcattttacacacacgcacacacacacacacacacacactttttctaatatatgaggctagtctgcagagtccacagcccaggtgtccatttatttccacttcttcacctcccaaagatttagagctccatgatctaccaaggtgaagactgccaatcccaggttggagaagacccgtcagagtgtggaggtgccaaactgagaggcacaggaagcagacagccacatcaaacttttttgatgaactactgcaaattggtgtttgttctaggaaagaaagaggaagaaaaattacacaatgtgaattgaacataagagcagtgctctttacagagtatgagaagggaggatgggggagaatctgattaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttctttttttttttttttttttttttcctctgtgcatcctagaaaaactcccaggactagacttaggaggaggcaatcaagttatgtggtaaaacaagagtgccttttctgttggatatccactttagtttcctggcttccagggcataagatgtttagaaactttttttctctaaacataagaattattgtgtaccacaattttgaaccaccgatttccatatcttcagcagctatcaacttgccaattccctttgggtctcctttgtatattcttatgtttccttctgtttccagttgtcctcaaaaagagttgaggggggcatgactcttataaaatggataaaaatgaaactgtacagatgtttgcctcccttgtatctgtgagcatgatctctatcaggctggaaaatctgctttatcattttgtatatttgactattttgtattcagcattacttgactccttatgtgcatggcaatgtattaaaatgtgggatttctaaaaaaaaaaaaacactttctctatcttatcctcaccctttttaaatataaaaaaattaactggccgccgttttacaacggtcggacttgtgcctggnggtacccaaattacgccttgggcttccccttttgccg

SEQ ID NO: 346585 - DNA, 1947 bp, Homo sapiens
ctcactgggggtaaaaggggttctatttgcttaaactcatgctcgtaggcaattttagggctctctggggctctgaatggtttctccaccaccacctttcttccaccaatagaaagatgttgtccttacaaggccatgtctgagaagaccatggtttaactagtaaaagaagctcacattgcagagagctgaataataccaggctcttgactttgtactgtgtgtcacagtcatgattgggacagaaggaaccagtctgctgaaaagtcaagccagcacaaatatttggaaactaattccactgaaactcttgtatcattaaatcatactattgtagtttcagttaatgtaattatttaatatcaggcactaaattaaatagctttgcacaaaattttagaaaagatcaatcttgtaacaaaatttaatattaacagtaaaaagcacctgagaaaagaaaatatcgatctgttgtggtttatatacttgagttattcttagaactttgtggagattgacacatgctctgataaaaaggaagaaaatgttttgaattcaagaatgctagactaatagaaatagcccagtctctctgggccactgctcttcagtatggggtgctctctgtccctccttagcagatggggttgtttggaggctaaaatgagctaagggaagaagctatactgtgcctccaatatcccttatgtgtaattagagtgccgatctgggctgcaggctttattcaatgattcctttcccttacttgaggctttctctgtagagctgttatttctgagcctccattctgggatttacaaaggaaacagaatgatgaagaagtaacaatcagcattttacacacacgcacacacacacacacacacacactttttctaatatatgaggctagtctgcagagtccacagcccaggtgtccatttatttccacttcttcacctcccaaagatttagagctccatgatctaccaaggtgaagactgccaatcccaggttggagaagacccgtcagagtgtggaggtgccaaactgagaggcacaggaagcagacagccacatcaaacttttttgatgaactactgcaaattggtgtttgttctaggaaagaaagaggaagaaaaattacacaatgtgaattgaacataagagcagtgctctttacagagtatgagaagggaggatgggggagaatctgattaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgttgggtttttctttctttttttttttttttttttttttcctctgtgcatcctagaaaaactcccaggactagacttaggaggaggcaatcaagttatgtggtaaaacaagagtgccttttctgttggatatccactttagtttcctggcttccagggcataagatgtttagaaactttttttctctaaacataagaattattgtgtaccacaattttgaaccaccgatttccatatcttcagcagctatcaacttgccaattccctttgggtctcctttgtatattcttatgtttccttctgtttccagttgtcctcaaaaagagttgaggggggcatgactcttataaaatggataaaaatgaaactgtacagatgtttgcctcccttgtatctgtgagcatgatctctatcaggctggaaaatctgctttatcattttgtatatttgactattttggaatagccatcacttggcgccccagtgcccgggcagtgttaaaattggggttttttaccgggaaaaaaaaaaaa

SEQ ID NO: 346586 - DNA, 347 bp, Homo sapiens
gattagatactccagtgatttgaagtgttttactataagagatcaaataactcttttactataagagatcaaacgactaataagattaaatgaagaatgattgtgtgttcaggatctacagagctgaaaatggctgaattaccatactcagaaatatccatctcttctaacttccagaaaaaaactcaacaaaacagggtaatttgtaaccgggtgcggtggcttgtgcctgtaatcccagcactttgggagatcaaggtgggaggattgtttgaggccagagagtttgagatgagcctgggcaatatgatgaaacccccagtctttaaaaaaaaaaaaaaaaaacc

SEQ ID NO: 346587 - DNA, 522 bp, Homo sapiens
cagatgagagcagtgtggctcagcctacagtgagactgagagtctggagcccatctcctcgcctccattcatcgcccctgccagctccccctgctccctccagcccacatcccaactccgagaagctcagggtcctaccaagaacgatctgaaaagcactggcgtttgtgttaattaataatataaaaatctaggattagatactccagtgatttgaagtgttttactataagagatcaaataactcttttactataagagatcaaacgactaataagattaaatgaagaatgattgtgtgttcaggatctacagagctgaaaatggctgaattaccatactcagaaatatccatctcttctaacttccagaaaaaaactcaacaaaacagggtaatttgtaaccgggtgcggtggcttgtgcctgtaatcccagcactttgggagatcaaggtgggaggattgtttgaggccagagagtttgagatgagcctgggcaatatgatgaaacccccagtcttta

SEQ ID NO: 346588 - DNA, 185 bp, Homo sapiens
cagtaaaggctagttctcttccttctccctttgggaggttgcactctttggcctcaattttcctttaactctccatccattcttacacaagactatttttctttcttccactgtctgttggtaaaagttccctatggatcagtctttggccctcagccctttatttagatttttttttttttttt

SEQ ID NO: 346589 - DNA, 371 bp, Homo sapiens
ccttgtagcttgttttcttcacttactaatacatcatggaagttcctcccatctcagtaggtgtaattcatttccttcaacagctatatgatactccatgatatagatgttccacagttcagttagctctcccttattgacagattttacagttttttaaccacttttctacaaataatgtaataatcatccttgattttctatgttttacaagttagtacttgaatattttttacatgttagaactttaatatctctaaagtatttcttagaagtaaaattgctgagacaaaggatatagagtttttatttttatttatttatttatttatttatttatttatttattcatttatttttgagatggagtc

SEQ ID NO: 346590 - DNA, 703 bp, Homo sapiens
ggttttgatttgcatttctctgatgattagtgatgttgacattttttcatataccttttcacatttgtatgtcttcttttgagaaatgtctattcatggcctttgcccaccttttaattttatttatttatttctgttgctgttgtttgagttctttgtatactctattcctattatattggtcccttgttggatgaaaagttgcaaatatttttccgatcccataggttgtctctttactctgtaggttatttattttattgtgcagaagctttttagtttaacagagtctcacttgtctgtttttgtttttgttggctgtgcttttgaggtcttagtcataaattctttttagaccaatatccaggagagttttccataggttttcttctagaatttttgtagtttggggcctcatgtttaagtccaatccattttgagttgatttttgtatatggtgagagatatgggtccagtttcattcttctgcatgtggctattcaattttcccagcaccatttattgcagagggtgtcctttccccagtgtaagttcttgtcagctttgtcaaagattagttggctttaaatctggggctttatttctggattatctattctgttccattggtctgtgtgtgtatttttacaccagtatcatggtgttttgcttactattgctttgtagcataatttgaagtcag

SEQ ID NO: 346591 - DNA, 438 bp, Homo sapiens
tctccaagtgtctccccaagttagctcaagggcttgggagaaacaaagtgctgtccctcagcctgggctgctcagatcctcagtggaaaggatctacagtgactacaataaccaagtgctacaaaaacgctgtgacgaggaatctgaacaacagagatttgagggaaacaaaacactttcgacgaaggtcctgctgcttgtcttcagcttggtaccaattagagcttcactggaggtgaaaagggcagacacggttgctgagtggctggttggagagtccctgagagattacccaagaaactcagttgcggcacgtggtggagcagcctctcagaaaatggagttctaagtatagtaacaatttagttacatagttacttccatttccagagatgtgatcctttgctgtgtaagttatgttttctaataaaaatgata

SEQ ID NO: 346592 - DNA, 486 bp, Homo sapiens
tctccaagtgtctccccaagttagctcaagggcttgggagaaacaaagtgctgtccctcagcctgggctgctcagatcctcagtggaaaggatctacagtgactacaataaccaagtgctacaaaaacgctgtgacgaggaatctgaacaacagagatttgagggaaacaaaacactttcgacgaaggtcctgctgcttgtcttcagcttggtaccaattagagcttcactggaggtgaaaagggcagacacggttgctgagtggctggttggagagtccctgagagattacccaagaaactcagttgcggcacgtggtggagcagcctctcaggagatttttagggatgcaagatgaaaggagctaaacataactataggaaatggaggctgttatcagcatctagcttaggatggcgagccaagcatggctctcaggtgcaactcacatggagacgtggctctcaggtaaaagatacaactcag

SEQ ID NO: 346593 - DNA, 451 bp, Homo sapiens
tgtgtgtatcaactgagacaacccaacaattccatcagcatccctgcagtcagatatctgctaagctctgatatcatctgtcattactgagaacagagctctgtccttcacttagggtgagacaggacaagggaggagaggcaggccagtccacccagatccaaggatatgcaagaatggaagggtcaagagccacggatatgtatgcagtggaaatgtagggtgtgttgtacaagtatgatctgcaaagtattgttaaagccgtctaaggtgctctccaatcattcattcactattgatcacttagcaactgcctgcctagactagatgctaaagaaagagaaaagtaaacctaccccgtgccctcaacaaacacagtctagcaaaggagataccataccaattggagatttggagagactgttaaaatatagattgctgggtcccatcc

SEQ ID NO: 346594 - DNA, 402 bp, Homo sapiens
tctcctctagggtaagaaagacaccctaccacagtctctgccacaggggaagggcagaagggtttcccttggctggaggagatacccgcatttctagggaggttcttagggaggcacagcctcatctcccatcaccttctgtccctttgcccccgttcctactcccacatcctcctgtcctgggatttcccctactacaaagccttttgcacatgttgtttattcttttgatcagcaaatagttacaaataggcagtgtagaccaccacaggtggtccggcacacctactaagtgccgggcatgcgcaattcagcagtgactaagacaggcccggcctctgccctcatagggcttccagaccagggcagggatatagatgaacaacagacagtcaagaaggg

SEQ ID NO: 346595 - DNA, 470 bp, Homo sapiens
ggtctctaataatattaaggtcctgtgcaggaaaaaacaagatgtacttagggagcacagctgctgttttcatgttcaactggtttcatgatggttctgatcctaggttgagaaaggacttagagaatcaactggctactaggatactatttaaaaaaaaggatcttgattggggatcatgactgagggtacaagaataacgggttcaggtaggagattcatgttgttaatgctgctgacctgatccagaaggtttaagttgaattttgaggtggtgtataaaatgcccccataaaaccataaaagcataacacatatgacatcaaaagaaagaaaaatagttggctgtatagccgttaattctcaagagaaatatagcaaagtagaccaggaacaatatttatggctccagaaaagtctttacactgatgtgtatggaatggttgttttaaaaagtgatcgtgaattta

SEQ ID NO: 346596 - DNA, 838 bp, Homo sapiens
aggagggggcagggacgggacgtgggaaaatgactacgcgtcactcgtgatgtcgcgcatccgataggcccttttcagatggcaaaaggcctgagggtgaatctgggcgagctggttgagtccatgcgtttgtgcttcctctcagtccactttcgcttacgatggggcgactcttgtccatcgtcacctcaccgggaaacttttcctgccgggccagttaatggtcccctgtaccatccccatcctgagtgactactaagcagccgcagcgactcggggttgctccgtgaccacgttactcagttaaccttcttgttccctggagaggcggagctgaatggcccggacggggtttctccatgtttcccaggctggtctcaaactcctggactcaagcaatctgcccaccttgcctcccaaaatgctcctccaaaaaaggagtgtgccgccacacccagcctgagcaacttttgtttttaaggtgaaggacatgtttgcttccctttccaccatgattgcaagtttcctgaggcctccctagccatgctgaactgtgagtcaattaaacctctttcttttatgaattatccagtcttgggtatgtctttattagcagtgtgagaatggactaatacagaggtgtgctgtattaataatgctactcatttgtttcctaatttgctttaatagagaagagcagtttccttggcctggaattgtacaaaagccatggcttatcttttcatggcttatcctattgaaagtgacctctattgagatactattaatagttatagctacaaataaattagtttaatactttgcctgcaaccatttt

SEQ ID NO: 346597 - DNA, 787 bp, Homo sapiens
aggagggggcagggacgggacgtgggaaaatgactacgcgtcactcgtgatgtcgcgcatccgataggcccttttcagatggcaaaaggcctgagggtgaatctgggcgagctggttgagtccatgcgtttgtgcttcctctcagtccactttcgcttacgatggggcgactcttgtccatcgtcacctcaccgggaaacttttcctgccgggccagttaatggtcccctgtaccatccccatcctgagtgactactaagcagccgcagcgactcggggttgctccgtgaccacgttactcagttaaccttcttgttccctggagaggcggagctgaatggcccggacggggtttctccatgtttcccaggctggtctcaaactcctggactcaagcaatctgcccaccttgcctcccaaaatgctcctccaaaaaaggagtgtgccgccacacccagcctgagcaacttttgtttttaaggtgtcagccatcagaccccaagtctccagctgtgttgagttatctgcaggccctgattgtgtgtgccaaggtgcaaagaaataaattctgtcaacaatcaagtgactttggaagaggttcctgagcctcagatgagaccccagcctggccaacactttgaagccttgtgagaatgaccatccaactaagccttgccctgactcctgacccacggaaactgtgcgataataaatgtatattgttttaagctatgacgtttgggataatttcttacatcatagacaactattgcagccatttgttatt

SEQ ID NO: 346598 - DNA, 307 bp, Homo sapiens
acggggtttcaccatgttgccaaggctggtctcaacctcctgacctcatgatccgcccacctcagcctcccaaagtgctgggattacaggcgtgagccactgtgcccatcctgctaatttttgtatttttagtagagatgggggtggtttcaccatcttggccaggttggtctcgaactcctgacctcaggtgacccacccacctcggcctctcaaagtgctgggattacaggcatgagccaccacacccagccacagtttccatatcctgtgttcctcttcctggaagattcttcttagtggtctc

SEQ ID NO: 346599 - DNA, 130 bp, Homo sapiens
gtacatagaagagagagcaaaagaatataaagataaaataaattaagataataatagaaatgaaaaatatagaaagctgggcacacacatatctagacatgataaatacataggagagagagcaaaagaa

SEQ ID NO: 346600 - DNA, 332 bp, Homo sapiens
caaaatacatgtgataaaacatacacattagtcactctgcttagcacccaatgtcaaactggcaaggcttaaatttaccctcacatgggccctgtcatctttaatctccgactaggagtttcaacatgtggtctctaggcaagatggtcaccctgagtaacagagaagataagaaaagggaaaggagagaaggaaagtattgcctgtggcagggtggggaaggtgaatggtatagggaagccagagaaaagacccactcattgcagcaacactgaaaagttcaggtggctgcttctcggtagcaaagggatctttttcagcagtctcgttag

SEQ ID NO: 346601 - DNA, 2071 bp, Homo sapiens
ctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccagcaccggcatggaccaagcaacttctctgagccagatgctggggacgcagaggtgaacccagagacatgatcccatctgctcagatcttcatgtcagaacacgctttattacagtctcggcaagggggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgtcggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggggacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctcctctctttttttttccccgcatatgcagctttttgattgtacttgattttatagagacagcacagttccagcaaagacatcaaaaggggat

SEQ ID NO: 346602 - DNA, 2046 bp, Homo sapiens
ctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccagcaccggcatggaccaagcaacttctctgagccagatgctggggacgcagaggtgaacccagagacatgatcccatctgctcagatcttcatgtcagaacacgctttattacagtctcggcaagggggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgtcggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggggacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctcaactctgccacttcctgttgagtgagtttgagtaagtcacctcacttctctcaacctcagtttcctcagtggtagaatgcgagttctgataccttacaggttgcagtgaggattcccgtcaatataagggtctcagcacatggcagacacctaaaaaaaaaaaaagtatgaggatggaggaaggcccctcaaacctggttgaacacgtctgctgcctaggccctggcctctctgggtgttctgcacacagatccttctgcctggggcaagacacttggctttgaatccatgtcacttccccacattct

SEQ ID NO: 346603 - DNA, 386 bp, Homo sapiens
ccttaaaggtcccatctccaaaaacagtcacatagcaggctactgcttcaacatatgcatttgggggaggggacaccattcagttcttaacagggtggtcaccgcaaacatggaaagtcagagccttctccccttcagaattcccgcccccacccagggatggggaggaggagcagagaggtatgggaagcagacacggagagtggcaggtaccatgctggggtggctcaggagtgcttcggaggacatatggaactggcagggctcagtgcagggaggcggaggccctgggagagccgtgtcctgagaagggcctgggctacaaccctgggcaagttacttcacctctgagcctccgatgctctgtgaaatggaaggaatgtgct

SEQ ID NO: 346604 - DNA, 1945 bp, Homo sapiens
ctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccaggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccaggggtatgagggaggcctggcagcccactactccctcctcacctgctcgggccctgcctgctgggccctattgtctgggtctgggggccctttcctgccccatgtgaacttgattcctcctcgcgtttctgtcggtgaccagacagagcctggcctgggccaagtccccactgaccacactttccccaaggctgggtctcaaaggaccctacaggatggggacaggaacaaggatgggagtcggggaggggctgtcaggcagagggcagatgcagctcctcgggtgccgctggctggagtcctttgtctccatttgctcagtgcgtaattgtcattttgtgggggacttccttggtggggcttttccatgcttttcctctccctgatggttacaaagaggagacagtcaggatctgggaggagctggagccttccccctgtgctgttgaactctgggaggggcagccagaggggctgagagtgcaccatcctgaaaagagagggtctttaagagataagatttaggctagggaaattcactagaaagagacaggtggccctgggttttttttcctgccatccaaagggaaccagtcttacccaaaggcttaaggggtcaccttagcccagtctcaggacactcttctccaatcagatcgctgcttctagttgcactgctcctggattctgttcttggggaacagaaggtggcaggacaggccccacaatctgcaattccagctccctccagaggggacagtcccagcgtttgcaagagagcagcttgtggcctcccttaggcaagtttaaaagccagatgtcctttttcccagaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctcctctctttttttttccccgcatatgcagctttttgattgtacttgattttatagagacagcacagttccagcaaagacatcaaaaggggat

SEQ ID NO: 346605 - DNA, 1241 bp, Homo sapiens
ctcctgggtcacattctgctgttgttgggaaacagggagtgagtgaagggaacctgggaacccttctcccctcaccttttaaggatgttctggggtggaataaagagaggtggagggtggggtgcctgggcccagcctccctggctcctggtccttctttcttcagcagggagttctggcaaggcctgggcctggggagggggcctgggtgcagttttctcctgcggtgtggttggctcttttgtcttccaggatgggcctgtggggtctgtgtggggaaggaaggagctgggagcctgggctgcctgtgtgtcggctggatgctgccagcaccggcatggaccaagcaacttctctgagccagatgctggggacgcagaggtgaacccagagacatgatcccatctgctcagatcttcatgtcagaacacgctttattacagtctcggcaagggggtggctccatctgggccgcatctccaggactcctggcctggacttctctttggacctcgggtgaccttggattctggccacagtgacttagcggtcagactccggtggttttctagcccgctgggtgactccctgaagatctcatcctcttcacacctgttgggatggagcctcccatggataggaactcttcctggttgatgctcagcagatgactgatctggctctggaggacagctccagggaatgcggagtggtgtgtactattcatcagcttgggctgccacagcaccatgccagactggatggcttaaacatcaggaatttattttctgccagttctggaggctggaaagtccagatcaaggtgttaagacttggtttctggtgaggcctctctccttggcttgcaggtggcaccttctcactatgtcctcacatggccttttctctgtggagagggacagagagcatgagcaggctctggtgtctcctcctcttcttataaagacactaatatcaccatattagggcttaaacctatgacctcatttaaccttaaccccttaaaggtcccatctccaaaaacagtcacatagcaggctactgcttcaacatatgcatttgggggaggggacaccattcagttcttaacagggtggtcaccgcaaacatggaaagtcagagccttctcctctctttttttttccccgcatatgcagctttttgattgtacttgattttatagagacagcacagttccagcaaagacatcaaaaggggat

SEQ ID NO: 346606 - DNA, 144 bp, Homo sapiens
ccttcatcgcatcttgctcccatcagtaaatcaatgagtgcttgtttatcacgctcctgtagtgagtcaggtgttgtgcttgtgttttaaatatgtataaaacttgttctctactctatagaagctcctgatgggagaaactgg

SEQ ID NO: 346607 - DNA, 1715 bp, Homo sapiens
  misc_feature (439)..(439): n is a, c, g, or t
  misc_feature (548)..(548): n is a, c, g, or t
  misc_feature (1459)..(1459): n is a, c, g, or t
  misc_feature (1473)..(1474): n is a, c, g, or t
  misc_feature (1513)..(1513): n is a, c, g, or t
tccccccatcaaaaaaactggagaactataatgtgcataaagtgcacataacataaatgttgtttatatttaatttaatttaatttttgagacagggtctcactctgttcccagactggtctcaaactcctggctcaagtgatcctcctgtgtctgcttcccaaagtgctgtgactgcagacatgagccacctcacctggccaaaatattcagtttaataattatgaagcagatacccatgtaaacatcgttacaaaagatcattgctagcatgccagaagccccagtgtgcccctttccaatcatatccctctctctaaccctaataggtaaccactatcctgacctttgtaataattttcttgtttttaaaatgtagttctggcctggcgtggtggctcatgcctgtaatcccagcactctcaaactcctgacctcnggtgatccgcctacctcccaaggtgctgggattaaaggcgtgagccaccgcgcctagcatatgtttatttttaatttagaactcatcgtggcttgtctatatacattgnaataatgatgtgacacacaaactgttgtgaaaaatgtcagttactttgaatgtaagcattttttccaaaatcacttatgtgtctaaaccaattccttctataaatcagtaagaaaatgataaaacaattcaacaggaaaatgaacaaaggccagaaaactcagagaagaaacacaaatgttcaataaacatataaagatactaaattaaattcatgagtaatcagaaaaattcacatttagatggaatcccttttattcatccataacttcagcaaaaagttggagaatacccagcggtgaaaaggtgttgggaaatgaatgctgtcatattctgctgacaatagagtaagttggcacaaaatttttgaaggcaattaaaattttatatctacatagtcttcaccccaagaattccatttccagatatctatgctacaggaatacttgcacatgttcacaaagaagcatgtacagggatttcattgcagcaatgcatgtaacaagaaaactaagcataatctaaacattcatcaatgggggaattattaaataaaccatgatgcatccatactatggattatgcaggagtttaaatgaatggggtgaccctctcagtactgggaaggaaagaaatctaaggcatatcatgaagtgaaagaatcaagttgcaagatgttaccctttatgcgaagaaaaaattttaaaaccacaaaacaaatctattttgctttatgtaaatatgtatgtaggtaaatgaggaaaagtctggaagcatgtatactaaatgcagagtagcattacttcagggatgagggagtagggcacaaggagagtttttgttatatctgttattgcatttttatatattaaaaatggaatcatgggctgcgggtggtggctcatgcctgtnatatgaacactttnngaggccaaggtgggaggatcacttgagcccaggagttcnagaccagcctaagcagcataggaagaccctgtctctacaaaaaatacaaaattaggtgggtgtggtggcatgcacctgtggtcccagctactggggaggctgaggtgagaggatcacttgggcctgggaggtgaaggctgcagtgagctgtgattgtgccactgcactgcagcccagaggacaaagtaagaccctgtctctg

SEQ ID NO: 346608 - DNA, 698 bp, Homo sapiens
tccccccatcaaaaaaactggagaactataatgtgcataaagtgcacataacataaatgttgtttatatttaatttaatttaatttttgagacagggtctcactctgttcccagactggtctcaaactcctggctcaagtgatcctcctgtgtctgcttcccaaagtgctgtgactgcagacatgagccacctcacctggccaaaatattcagtttaataattatgaagcagatacccatgtaaacatcgttacaaaagatcattgctagcatgccagaagccccagtgtgcccctttccaatcatatccctctctctaaccctaataggtaaccactatcctgacctttgtaataattttcttgtttttaaaatgtagttctggcctggcgtggtggctcatgcctgtaatcccagcactctggaaagccaaggtgggtgaatcacccacggtcatgagtttgagaccagcctggccaacatggtgaaaccctgtctctactaaaaatataaaaattagctgggtgtgatggagggcacctgtaattccagctacccaggaggctgaggcaggagaatcccttgaacccgggaggtggaggttgcagtgagccaagatcgcaccattgcactccagcctgggcaacaagaacaaaattccatctgaaaaaataaataaagcaattctcctgcctcag

SEQ ID NO: 346609 - DNA, 1421 bp, Homo sapiens
caggtgcgcattgccaatgcctggctagtcttttaatttttaatagagatggagtttcactacgttgcccagactgatcttgagctcctgggctgaagggatcctcccaccttggcctcccaaagtactgggatcacaggcatgagccgtcacacctggccatggatgaaaacttttttctttttgtttctcttctcttttcttggctttcttttctttttgagacagtcttgctctgtcttgctctgtgaagtgacatcatcacagctctcaatagttttcacttcccagacctcccaagctcaaatgatcctccctcctcagcctcccgagcagctgagaccacaggcgcatgccaccatacccagatgattttttaattttttgtagagacaggcccagactggtcttgaactcctgggctctagcagtcctcccacctcggtctcccagaatgttggaattacaggcaggagccaccgcgtcccacttgttttccattttctgtcattttaggggctaggggctaggggctagaggaagcagaggtgaacgtcatcatgcatctttttctaactgtcttcttgctcacccctttcagaaaagcattgagctggccgggcgtagtaggtcacgcctgtgatcccagcactttgggaggctgaggtgggtggatcacctgaggttgggagttcaagaccagcctggccaaaatggagaaaccccatctctactaaaaaaatacaagattagccaggtgtgttagcaggtgcctgtaatcccagctactcaggagactgaggcaggagaatcacctgaaccctggaggcggagcttggagtgagccgagattgtgccattgtactccagcctgggcaacaagagcgagactccatctcaaacaaagaaagaacaagagaagcatgagctcttaggaacgtgacgtgcatccccagctacacttctgttaccacttcagcatcaccttcctccccacttcatcaagtcttttactccagacaggctgcagctggtgacatgaaagaccggtcaaggccagctaaggcatctgcttgaggcctcccgtgcctaggatggggcgcagcctgcagttggctgtcacagccttgtgtcagaaacaccctttaaaatttaatgtttccttcacgggtaccctttggcataaaaaaagcccaatctgagccggacgcagtggctcacgcctgtaatcccagcacattgggaagccaaggtgggtggatcacgaggtcaggagttcaagaacagcctgaccaacatggtgaaaccccgtctctactaaaaatacaaaaattagttaggcatggtggcacacatgcctgtaatcccagctactcaggagcctgaggtaggagaactgcttgaacccagaaggcagaggt

SEQ ID NO: 346610 - DNA, 687 bp, Homo sapiens
aatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctcattttagtgactcctaaggctagtccttttataaacaactttttctgacatagcatttatgtataataaaccagacatttaaagtgtacaa

SEQ ID NO: 346611 - DNA, 465 bp, Homo sapiens
aaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggaggcagaggcgagcacatcacttgagctaggagtttgagaccagcctgagcaacatggagaaaccccgtctctgcaaaaaatacaaaaattagctgggcatggtggtgcatgcttgtagtcccagctactcgggaggctgaggtgggaggatcacttgagcccaggaggttgaggctgcagtaagcgagattgcaccacattccagcctgggtgacagagcgagaccttgccagaaaaaaa

SEQ ID NO: 346612 - DNA, 871 bp, Homo sapiens
atctgcagcctgtggcctcctgtcaccctcccacccaccatggaaatgccctggcccctagggtggattctgcttcttttgggaagccccctcatccacgctgagcctctgttcccgagagcctgatgtacctcccctcctcattcatggagaagatggtgctggtggctcttcatgctggctacatctttatccagacggagaagaccatctacacccctgagtacttggttcactaccgggtgttcactgtgaaccacaagatggaccctgtgaccaggacattcactctggacatcaaggtggtctttcccgatgaggggtggggggtggtggtggatcctggacactggggttacacggtgtgctgaagtcctgggggcatgagccaccagggccctcccagagggcagtcaccagccccaccccctatccccacagaacccaaagggaatcaccgtgattagccagagtctgatggccaaggatggcttctttttcagctcctttcacctcccagagcttgtcagtttggggacctggaccatcgaagccagctaccaaagtacacccaagcagaagttcgaggctgcctttgatgtgaaggaatatgtcctcccatcttttgaggtccagctggtcccaaataagactttcttttacctcaaggatgaggctctgggcgttgacatccaggctcggtgagcccccttcctcccagctctgccagaagaccagggacacaaagattgagtacagagaaacaagcaccaggtgctatggctcacatctgtaatcccagtgctttgggagaccaaggcaggaggatcacttgaggccaggagttctagaccagcctggacaacatggc

SEQ ID NO: 346613 - DNA, 472 bp, Homo sapiens
ggcccacctcctcacacctgtctcctgccttccaacttctgcccaccttgtctgggtcttatttcttggctttcttaatggtcttaagtgtgtctagctgcttggacattgcaaagaatgttcacttctattatttttgtcgttagtatatcattcaaaagaagcactccccaccagccttgtggactgttgtgagcagtctgtgagactggatatcaaggtgctttagggacttttagacaaagccacagaatcacaaattataaggcctgatttgtccacagggtggtgagccagctcctcccgccactgtcccctgaccccacaattctttccatgagccctgtcttcctttttcccatctccacgggccttggcaccagcccctgttctctaccagccctggttgtggcctctgccagtctctgttcccctgccggaaaggaaagcctggctcaggttttgcctctga

SEQ ID NO: 346614 - DNA, 319 bp, Homo sapiens
acaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttaggtgatagcctatgtccaggccccttctcctccccctgcctggtttccttctatgctatcttccccctcctctttctccacgtgcgcacccttctccctgtcctttctccacatactcctcctctgactctagtgtccctct

SEQ ID NO: 346615 - DNA, 345 bp, Homo sapiens
acaggtctcagcttgactatgaagttcccagggaaaaggccttccaaaagagcagcaccggcttttcacctgagacttccttcctggatagccaggtgatgactgctctgaagatggagagatacctgaagaagatccacttcctctatctcaatgtggctcccagccggtactttagagacggggttttgccacattggccaagctgatctcgaactcctggcttcaagtgatccacccacctcagcctcccaaagtgctgggattacaggcgtgagtcaccgcgcctggcctcgacatctttttaaaaacacattctctttattaaattcactttgttgaaat

SEQ ID NO: 346616 - DNA, 725 bp, Homo sapiens
aaaacatgtcggagactgctccacttgctcctaccattcctgcacccgcagaaaaaacacctgtgaagaaaaaggcgaagaaggcaggcgcaactgctgggaaacgcaaagcatccggacccccagtatctgagcttatcaccaaggcagtggcagcttctaaggagcgcagcggcgtttctctggccgcgcttaagaaagcgcttgcggctgctggctacgatgtagaaaaaaacaacagccgtatcaagcttggcctcaagagcttggtgagcaaaggtactctggtgcagaccaaaggtaccggtgcttctggctccttcaaactcaacaagaaagcggcttccggggaaggcaaacccaaggccaaaaaggctggcgcagccaagcctaggaagcctgctggggcagccaagaagcccaagaaggtggctggcgccgctaccccgaagaaaagcatcaaaaagactcctaagaaggtaaagaagccagcaaccgctgctgggaccaagaaagtggccaagagtgcgaaaaaggtgaaaacacctcagccaaaaaaagctgccaagagtccagctaaggccaaagcccctaagcccaaggcggccaagcctaagtcggggaagccgaaggttacaaaggcaaagaaggcagctccgaagaaaaagtgaaactggcgggacgttcccctttgaaaattttaaacggctcttttcagagccacc

SEQ ID NO: 346617 - DNA, 479 bp, Homo sapiens
tgggctgggcacagtggctcatgcctgtaatcccagcactttgggaggctgaggtgagtggatcacttgaggtcaggagtttgagaccagcctggccaacatggtaaaaccccatctctattgaaaatataaaaattagccaggcgtggtggcactagcctgtaatcccagctacttggaagactgaggcaggagaatcacttgaacctggggggcagaggttgcagtgagccgaaattgtcccactgcactccagcctgggtgacagaacgagactctgtctcaaaaacaacaacaacaaaaacacctcacagtggcttatcattacttttatggaaggagattgcaacattctcctccaaacccttcaatggcttttcttcatacttgaaaataaaacccgaactttttgtcagagcaaacaaaactctgcagatccggccctgcctgatctcttgaacctcacccctgccactcat

SEQ ID NO: 346618 - DNA, 440 bp, Homo sapiens
gttcaagggtatgaagaaaatccggtctcattccaatatgcagttagaaaaagaaggaaggattttaatagtcttttcaggtaattgtggctatatcaagtagcctctggaaaactcctccatatatccatggaagaatgagagtcaaaaggcaaataatatcttagcattattatgaaaacagttttgaccttgtggaccccctgaaagggttccaggggcctccagggtccccagactccaatgtgagaaccactgaaatggagacagcctggagaagggcctggacacagaggtggtcttctggagacgctgaatcctgtccctggcctatgtcttgctaggtcttaaagagcctattttcttctcctcccacacaccctctatggaggtagtgctgatgtctttctgtgctcacccaggtcctctgcccacctcct

SEQ ID NO: 346619 - DNA, 550 bp, Homo sapiens
gctcctctctctcccttgccctcaatgtctcaccagccagtgaattctcttgctgtcactgacttaattagccctcattctctctcatctggaatactgtctccttctcaccagcctacaggccatttttcattattctctcattggtctggtcttcccacccctcacaacctgagtcatagttcctagaagcaaatctgatcacatcacatccctactcaaaattctatacatcgtcacttttacccacagcatacaatgcacatttgttagcttcactcaaggcctttcaaaatctggctctattcttactttctttcttctcccacccctaactgaaataggccttctctttctaccatatatctaataactccccattcaggagaggcctttcctcaaactcatgcctttaaaaacccttttcctaagctagaaacatgggtggacaatctgctttcttctctactacaattaaaatatggtaaatatcactatttagcagcagtaggcctggataggatggtaaggtattgatgctgtctcttcc

SEQ ID NO: 346620 - DNA, 1800 bp, Homo sapiens
gcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcgggcgaaaattttgaccagagtcctttgagaagaacattcaaatccaaagttctcgcccactatcctcagaatatagaatggaacccttttgatcaagatgcggtgaacatgattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagtaaaaagaaccatagttttccttttgtggttattagtggctttattattgattttaacatttttaaattttttattcttctgtgcctatgcttacccatatattattgattttgttaaccttttttaaatgcagactttttgtcttccagccccattaagaacttttctttaccaagtatttttacattagataaaataattttacaagcaaataaaccagctcattgaactggtcattaaattgtgcgttaaattgcctgtaatctcattttcaatttttctttaccttaaagatgcttaaattatagaaactcaggccgggcacggtggctcatgcctgtaatcccagaactttgggaggccgaggcggacggatcacaaggtcaggagtttgagaccagcctggccaatatggtgaaaccccgtctctacgaaaaatacaaaaaattagctgggcgtggtggcgcacacctgtagtcccagctactcaggaggctgaggcaggagaatcgcttgaacccgggaggcagaggttgcagtgagccaagatagcgccactgtactccggcctgggcaacagagagagactccatctcaaaaaaaataaataaataaataaaaatttatagaaactcttacattttgcaggt

SEQ ID NO: 346621 - DNA, 1089 bp, Homo sapiens
gcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcgggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcaatacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggctgggcccagtgaactccccctctctgattacccccttcgggaggcatttgagctcctgggattagagaacctggtgcaggtgtttacctgtgttcttttagagatgcaaatccttctctactcacaag

SEQ ID NO: 346622 - DNA, 1156 bp, Homo sapiens
gcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcggtttggtaccaatgggctagaagcagatcgtcatggcaagagccaaggtgctgcaaatacgacttcaggcgaaaattttgaccagagtcctttgagaagaacattcaaatccaaagttctcgcccactatcctcagaatatagaatggaacccttttgatcaagatgcggtgaacatgttgtgcatgcctaaagggctatctttcaggacacaaacggacaataaagacccccagtttcactcatttataattaccagggaagatggttctcgcacctatggttttgttctcactttttatgaagaagttacaagtaagcaaatctgcacagcaatgcagacactttaccagatgcacaacgctgagcaatacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggctgggcccagtgaactccccctctctgattacccccttcgggaggcatttgagctcctgggattagagaacctggtgcaggtgtttacctgtgttcttttagagatgcaaatccttctctactcacaag

SEQ ID NO: 346623 - DNA, 516 bp, Homo sapiens
agcgctgagccatacgcgatactccgccgcagcgctgagcaatacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggctgggcccagtgaactccccctctctgattacccccttcgggaggcatttgagctcctgggattagagaacctggtgcaggtgtttacctgtgttcttttagagatgcaaatccttctctactcacaag

SEQ ID NO: 346624 - DNA, 1373 bp, Homo sapiens
gcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcgggcgaaaattttgaccagagtcctttgagaagaacattcaaatccaaagttctcgcccactatcctcagaatatagaatggaacccttttgatcaagatgcggtgaacatgattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggctaatttgtgttttgtggacattgacaaccattttattgagttgcctgaagaatttccacagttccccaataaagtggattttatccaagaactctctgaggttcttgttcaatttgggatccctcctgagggcagcctacattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaaaatggacctctctgcttctctgggtgaaaaagacaaggatttaaaactgcattgtgaagaggcagaactaagggactaccagctcaatgtacagctccgagaggtctttgctaaccgttttacacagatgtttgcagattacgaagcatttgtcattcagactgcccaggacatggaatcctggctgaccaaccgggaacagatgcagaactttgacaaagcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaa

SEQ ID NO: 346625 - DNA, 513 bp, Homo sapiens
ccaggagtatcagcgatactcacgccgcaggctgagcaatacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggctgggcccagtgaactccccctctctgattacccccttcgggaggcatttgagctcctgggattagagaacctggtgcaggtgtttacctgtgttcttttagagatgcaaatccttctctactcacaag

SEQ ID NO: 346626 - DNA, 423 bp, Homo sapiens
aaaatatacttctaattcttggctttattttcagttataaacatcagctggcctatctggtggtgtgcaagtagtatactgtgggcagtttcatctgtttagatgaggaatttattgcagggaattggaccaggacacctgacgcagctgggtcaaaagtctttcagtgattttcgtcttggtgacttctaatatagctcaggctgtcacatacttgtttaccttattttatttgcctatcttgttagcttggtaagaagttccttcattgttcagagatgatcttttatataggcaattcgtgtaaggattttcaggagctttttatttttcataaagaggatattcttcaaacatctttgtataactgttcctcaagaagttggtggaagctgttaaataatcttgtgtagttaatgttaa

SEQ ID NO: 346627 - DNA, 790 bp, Homo sapiens
tgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggcccgctgggacaggccccgctgggacagctgcgatagctcaacggcttggaccccagcgagaaggagaaattctcccagatgctcatcgtcaacgaggaactgcaggcgcgcctggccagggccgctcgggaccgagccgcgcagtcccagggccccgcgccccggaaccgcagctcagcccg

SEQ ID NO: 346628 - DNA, 503 bp, Homo sapiens
acagggggtgccgcggccctgaagaccccccctctcccctgcacagtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgcccccaccttcacgtttccctggctcgcggctgctgggcatgaggctttgtgtctcccttcccgcctcaccaacgttctcacttcattccttcctgcgtcctggccctgcccctctccaaacgctcccaagcgttcaacctctgaggtttgcacctgctgtctctgctggctgaaacggccattccctgcctggcgaactcctgttcagcctccctggcccagctcaaacactcactgtggggaagcctgccctcatcccc

SEQ ID NO: 346629 - DNA, 846 bp, Homo sapiens
ataaagacctgtctggtccttccccacttccctaatccatctgtctcccttgctatgtctctaaaccttctccagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaagacctaatagccaataagatagtattaatagatggggcctttgggaggtgagtggctcatgagggcagagtcctcaaaaccagataagtgcccgaataaaaggggccccagagagatcccttgcaccgtctaccatgtgaagtgtagaacacagcgagaaggccacctatgagccagaacgtgggccctcaccagaacccagttgtgctggcaccctgatcctggacttccagcctccaaaatgacgacaaagaagtttgtttttcctgagccatccacttcaaagtattctgtcatagctccccaaatagactaagacatctacttaaccttggtcaagttaactggggtcagccttgaatgtgcataaccgggttttccacttaggatccgataaatgtgttttatcgaatgattgttt

SEQ ID NO: 346630 - DNA, 649 bp, Homo sapiens
tgactcaccggtaaccacttcctgcagaaatcctccagccctgttagaaatgcctcagccagggggactcatctcctcaaacctgggggaccgagacctatgagaggtcacagcatgagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcactaatgcagaggataaagcaagcaaacaaaaaaacttccagaagaatcacagagttttagacctagaaaaaaactgaaaaatcatccattccactctcctcattttacagatgagggcatcgagcctcagagaaatgaaacttgcccaagaccacacagcaagtgagtgggggactcatgacccaagacactttttccaggcttccttctaccacatcatgctgcagaaaacacagcagatgggaagagacgaggcatgtggttgccatttctgtattacatccaattcatatttcatttagaaaatgtatttc

SEQ ID NO: 346631 - DNA, 890 bp, Homo sapiens
tgactcaccggtaaccacttcctgcagaaatcctccagccctgttagaaatgcctcagccagggggactcatctcctcaaacctgggggaccgagacctatgagaggtcacagcatgagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaagacctaatagccaataagatagtattaatagatggggcctttgggaggtgagtggctcatgagggcagagtcctcaaaaccagataagtgcccgaataaaaggggccccagagagatcccttgcaccgtctaccatgtgaagtgtagaacacagcgagaaggccacctatgagccagaacgtgggccctcaccagaacccagttgtgctggcaccctgatcctggacttccagcctccaaaatgacgacaaagaagtttgtttttcctgagccatccacttcaaagtattctgtcatagctccccaaatagactaagacatctacttaaccttggtcaagttaactggggtcagccttgaatgtgcataaccgggttttccacttaggatccgataaatgtgttttatcgaatgattgttt

SEQ ID NO: 346632 - DNA, 844 bp, Homo sapiens
cctagttttagaagtttcaatagcatacgaatttgggggggggaccgagacctatgagaggtcacagcatgagccaggacatcggaggtacccagacattgttatgaaactccgcatgtgcccctggtggacgctgctggacccagcatgcacacttctcggctaagagtcaccctggatgaaccaccattgccagcggggagcatgttgcagctttcccacgcagtggatgagaacgaaggttacgaccattgtgtgggaggcgtctgtgtagcaattgctggaatcacttgtggcattgtagaaagactgagcgtgggaaagaagacgcattctgaagtcaccccgatttatgttaaattatcaccttgactactgctatagaacgaatgtttatgtcccccacccaaattcgtatgctaagacctaatagccaataagatagtattaatagatggggcctttgggaggtgagtggctcatgagggcagagtcctcaaaaccagataagtgcccgaataaaaggggccccagagagatcccttgcaccgtctaccatgtgaagtgtagaacacagcgagaaggccacctatgagccagaacgtgggccctcaccagaacccagttgtgctggcaccctgatcctggacttccagcctccaaaatgacgacaaagaagtttgtttttcctgagccatccacttcaaagtattctgtcatagctccccaaatagactaagacatctacttaaccttggtcaagttaactggggtcagccttgaatgtgcataaccgggttttccacttaggatccgataaatgtgttttatcgaatgattgttt

SEQ ID NO: 346633 - DNA, 471 bp, Homo sapiens
tgcactaacacaaatgataaaaaattaaggaatttttagattacttgaagtatgagctgtgttttcttccttaactggaaatggctttccactgatggattcattcttgaccaattccctttaggacaatggcaaaatacagacaagaaggcatactatatggcctaacccagactgaatcaatgatcttggtctcattaataacagtgactttttatgatgctataacaagaattattcaccatgttcttaacaccaatatctacttatattacaggtacctattaaacacaaaaaaagaactgacgatgttttcctacccaatatggcagaaaatgttcaactgacagcttttcaggttcaaacagctccatccagattcccatttagagctgactggtgatgatatcttctttttccaacctttatttctatgagtatttgaatgaataaaaatgactccaaatgcca

SEQ ID NO: 346634 - DNA, 509 bp, Homo sapiens
tgggccaactgcagcagaaaaaaatgaagagggacctccaccagatgagaagccggcttgcccaggagcgcagtgtgaagctggatgctctccagcgtgcagaggagctgcagggtcaacttcacgatgcccagcggtcagctgtccccatgggctcgtcaggcgaccttatatcccaggctcaatactccccaacttctgcttccacatcatccagatactcccagcaacgctttttaaagactaatctcaaaggcagtaaaataacaagatggattcaaaggccacagactgtacctattaaacacaaaaaaagaactgacgatgttttcctacccaatatggcagaaaatgttcaactgacagcttttcaggttcaaacagctccatccagattcccatttagagctgactggtgatgatatcttctttttccaacctttatttctatgagtatttgaatgaataaaaatgactccaaatgccattaaatctcttacttaatttta

SEQ ID NO: 346635 - DNA, 435 bp, Homo sapiens
tgggccaactgcagcagaaaaaaatgaagagggacctccaccagatgagaagccggcttgcccaggagcgcagtgtgaagctggatgctctccagcgtgcagaggagctgcagggtcaacttcacgatgcccagcggtcagctgtccccatgggctcgtcaggcgatactcccagcaacgctttttaaagactaatctcaaaggcagtaaaataacaagatggattcaaaggccacagactgtacctattaaacacaaaaaaagaactgacgatgttttcctacccaatatggcagaaaatgttcaactgacagcttttcaggttcaaacagctccatccagattcccatttagagctgactggtgatgatatcttctttttccaacctttatttctatgagtatttgaatgaataaaaatgactccaaatgcca

SEQ ID NO: 346636 - DNA, 359 bp, Homo sapiens
tgggccaactgcagcagaaaaaaatgaagagggacctccaccagatgagaagccggcttgcccaggagcgcagtgtgaagctggatgctctccagcgtgcagaggagctgcagggtcaacttcacgatgcccagcggtcagctgtccccatgggctcgtcaggcggtacctattaaacacaaaaaaagaactgacgatgttttcctacccaatatggcagaaaatgttcaactgacagcttttcaggttcaaacagctccatccagattcccatttagagctgactggtgatgatatcttctttttccaacctttatttctatgagtatttgaatgaataaaaatgactccaaatgcca

SEQ ID NO: 346637 - DNA, 487 bp, Homo sapiens
tgggccaactgcagcagaaaaaaatgaagagggacctccaccagatgagaagccggcttgcccaggagcgcagtgtgaagctggatgctctccagcgtgcagaggagctgcagggtcaacttcacgatgcccagcggtcagctgtccccatgggctcgtcaggcgaccttatatcccaggctcaatactccccaacttctgcttccacatcatccagatactcccagcaacgctttttaaagactaatctcaaaggcagtaaaataacaagatggattcaaaggccacagactgtacctattaaacacaaaaaaagaactgacgatgttttcctacccaatatggcagaaaatgttcaactgacagcttttcaggttcaaacagctccatccagattcccatttagagctgactggtgatgatatcttctttttccaacctttatttctatgagtatttgaatgaataaaaatgactccaaatgcca

SEQ ID NO: 346638 - DNA, 551 bp, Homo sapiens
ttaaagcaaatgtaatttagaagtacatctaccacacataactaagagcctgcaaaggggaaaatacgcttaatcacaaatcatgaatccaatagcaaagaaagttcagagtttactgtttggtttttgagaagatactgtcactggggactttgtttctgtgtcatgaccaagtcatggggaaaaagagaaaagtggagggatgtgagggcctagacaggggaaaaaggagaacaggaggctcaagactggtgaggaaggggagtgggctgggcgtgcggctcatgcctgtcatcccagcacttcgggaggccaagggaggaggattgcttgagcacaggtgttcaaggctagcctgggcaacacaacaagaccccatctctacaaaaaaaaaaattaagccaggtatcgtggcatgcacctgaaacccagatgccagggagactgaggtgggaagatcacctgagcccagggagactgaggctgcagtgagccgtgatcgcaccattgcactccagcctgggcaacagagtgagaccctgcctcaaaaa

SEQ ID NO: 346639 - DNA, 550 bp, Homo sapiens
ttaaacataatcttttgctttgttaattctgaaataaaaagaaacaccttttctaaaatgtcttctaggtaattttgattggagggaggtcagagaaaagatgatttatgataaggactgatgtgaacatggcttagatgtttttacaaacataccaaagttcttgtgctttcttttctttaaagaaaagttgggctgagcgtggtgggtcactcctgtaatcctagcactttgggaggttgaggtgggcagattgcttgagctcaggagttcagcagcctgggcaacatggagaaactctgtctttacaaaaaatattatacaaaaataagccgggcatggtggcgcacgcctgtggtccaagctacttgggtggctgaagcaggaggatcacttaaccgcaggaggtccaggctgcagtgagctgtgactgtgccaccgcactccagcctgggcaacagagtgagaccctgtctcaagaaaaaaaaagaaaaattggtaattgctaatatagcttgaagaaagaagggggaaaagtaatgaaggagag

SEQ ID NO: 346640 - DNA, 486 bp, Homo sapiens
acttctgaaagaatgctgcgggagaggaggaaggagagcatcctggcttctggcagcagagccccactgtgacaggacctagcattcaccttcctcttctgttccgagtgcgagaagacttcagggacctctgtttcatggacattatcatattcttctcaagagtacccagcaagaggtttgcaaagaggagttattcagtgagtaagtgattcatgtagctctctaacaggcatctggattttgggtgctacagcttgcaattagagaacaaaatagaaggattatccacagtccttgtctgttatctcacgtttggtgggctgtagaatccatcaactttttcagggtattcaaaagttgatgaacaattgtggataatattgtcaagatctaaaacaaactcccttaaagacaaatcagaccactattaaggttcagttttttgggttttttggtttgtttgttttttgagacaaagtcttg

SEQ ID NO: 346641 - DNA, 471 bp, Homo sapiens
aactaacagtgagtgagtatgatgttatgagttattaaatcttaactaccaattgggtaattgaataaaatgctttataaatagaaaccatcgtaacaagaaattagtacctggcgttattgatttctgaaacagtaaaccaaattttttactcttagtatctggagaggctgaaagtttatttggtagtttgtataatttcatgctagtgtcagaaattctctatgctcctaccaccaaatctcactattgacatctctgtgcatattttctgcctccctttgattataattaatgaggtttttatgcacctattcaaaaccaattcctcctctgatacactggaacttatctcctttagtttactcagggacatcattcctgtggttttccgcttttttttaagcatcatctttctctctccttcagttaaacattctccatcagaatacagacgtgtgtattagctcc

SEQ ID NO: 346642 - DNA, 648 bp, Homo sapiens
gctgaagaactgttatccctctgcagtacatgggggtttgagctcacgtcaatgtgcctgacctaagggcaaatggagctaagcaggagggagaattagacacttgccacggcttggagacagggtctactgctctctgctgaaccagaggaaagaacacactggctcctgaaccttcgcaggaagacaaggcgagggctgctgggtgcccgtcgctgctcacagcacagaacgtcccactcctcagactctttgtccccgtcctaagactgtccttcacttggtccatccaatccaaaatatgggcatacgaaacacacctcatccttcacacacacaacatgctcaaccttcactagccacgtgactttctttctcacatcatcctgaatttgcttttctgaaatttacttttcaatcttctgacttttcttcatacctaagaagactggacaaagtgcttgaaaagcaaatggaaacattttatgaataactacgcaaaggaaagacatataaatatttttaaagtttcccttctacagaaatgagcttaagtcaacactacagttgccactaagtgtaaggattcgtgaaggggaaaacgacggactcccttccctctgttcttctcaagtaatgcaaattaga

SEQ ID NO: 346643 - DNA, 607 bp, Homo sapiens
gctgaagaactgttatccctctgcagtacatgggggtttgagctcacgtcaatgtgcctgacctaagggcaaatggagctaagcaggagggagaattagacacttgccacggcttggagacagggtctactgctctctgctgaaccagaggaaagaacacactggctcctgaaccttcgcaggaagacaaggcgagggctgctgggtgcccgtcgctgctcacagcacagaacgtcccactcctcagactctttgtccccgtcctaagactgtccttcacttggtccatccaatccaaaatatgggcatacgaaacacacctcatccttcacacacacaacatgctcaaccttcactagccacgtgactttctttctcacatcatcctgaatttgcttttctgaagactggacaaagtgcttgaaaagcaaatggaaacattttatgaataactacgcaaaggaaagacatataaatatttttaaagtttcccttctacagaaatgagcttaagtcaacactacagttgccactaagtgtaaggattcgtgaaggggaaaacgacggactcccttccctctgttcttctcaagtaatgcaaattaga

SEQ ID NO: 346644 - DNA, 486 bp, Homo sapiens
tatagggtaacgtatacacttcccatcgcgtagttttcctgctcaaaacttttttctgactcctcccaacccgcactttttaaagtccttaccgcgaggcggattcccgccctgggcgcctcccagtcttgtcttaaggcgccgtcgccccccacctccctcctcgtgccgggcccttatgctccccaggtcttccctccgtaatcaccgtttctcctgagcccgcgttggggaggtgcccggggctgtcctatgacaccgtgtgttcttgcctgccctgcaccagcctctggaaaatgcgctcctccgggatgcaggcatcttacttcaaagccctcctgtgattgtgttggccaaagggatcgggagactgagagagagagcagtagaaaacctgagacagagaaaagaagaatgagaaaggccataacagatggtagcgtagaggatgggtgaaggatttgccaagagacagcaaaagtggaa

SEQ ID NO: 346645 - DNA, 512 bp, Homo sapiens
tgggttgatcccaattctctgggactagtggcgagaaaagtggatctgtgaacagggccaggaaccataaaggaatcaatacttcactgggcaatttttgctcttcacaagaaatatcctaggatccttacaactcacactggagcctgaaatctaaaaacagacagggccttccattcatgagagtctgcggtttcccacaaaagatgaagagaaaaaactaacccaacatcctacataccaggtgagacttttctctgaagtaccaccaatgtagctgtggccagctttttccaaagtcctcccattcactcaggaggcaccgtggtttccaaagggaaaccttctactgaagcactgaccctgatcctcccttactcattttgcttggggacctcctaaactactcagaacttccacagcctgcaatagtacccactccctgtacccatgacaccttcaccttctcctctttatgtatttccatattcagcctgaccatcgcatcactc

SEQ ID NO: 346646 - DNA, 282 bp, Homo sapiens
agagctcaaggaagacaacttcttaattcggtggaagccctggactggaaatcttgttctcagagttctctcacttctcatccgaagccctctttttttaaatcttactttcacattctcacctaggagaatcccagggttaaaatgccatgagaccctgtaatgttgagaaaggaaagaaggaaggaaaaggaacttgctgagatgctgcatcacagttttgtatggaagcttcaggtctgcgtcagtcaggcatcacttttcctgctctagctgcctccc

SEQ ID NO: 346647 - DNA, 378 bp, Homo sapiens
cagtggtgcatgcctataatcccagcactttgggaggccggggcaggcgggtcacttgaggtcaggagtttgagaccagcttgggtaacatggaaaatcctgtctctactaaaaatataaaaattagctgggcatagtggtgtgcacctgtattcccagctacttgggaggctgagacaggagaatcgcttgaacctgggaggcagaggtttcagtgagctgagattgcaccactgcactccagcctgggcaatagagcaagactccgtctcaaaaaaataaataaataaaaaagaactatgtcctcaaaactgtcctgtgtagattatatatagaattcctatggctgggcagggtggctcacacctataatcccag

SEQ ID NO: 346648 - DNA, 239 bp, Homo sapiens
caagagagagaagtgggcctgaagttcagaaatcaaagttgggaattggggcctggcacagtagctgatgcctgtaatcccagcactttgggaggctggggcaggtggatcacctgagcccaaaagtttgagaccagcctgggcaacatgacgaaacctgtccctacaaaaaacacaaaaattagctgggtgtggcggtgcacacctgtagtcccagctacaagggaggctgaggtggg

SEQ ID NO: 346649 - DNA, 408 bp, Homo sapiens
aacaaagttcttcaaaacattccatgaggttcaatacaggcaagcatgacaaaatagatttaaaggcaaaatcagccggccaaccaacctaacatagagaatacaataaacaaacaaacaaaaagtcctaagcagcccaattcagagtgggaaaggccaggccagtgtcagttttacagagagggaggagtagattcctgccacgcagaaaccataactggccaaccctgcagtgctgctacaaacacagccatgacacaagatcaagaaaccctccttccatgatattctgttttaatcacatgcaagtttgcctttgtgagtagcaaagatggggtctcctacctgttatgatttgaggccccctgggaaggacccaattccctagtcctcacctcctctggtctg

SEQ ID NO: 346650 - DNA, 520 bp, Homo sapiens
ttttttttttgtttcccagtatatatgaaaatagcattatgttttaaaaatatctttgaacatgtgttcatggaaaaaattaaagaaaatacaaaatatatagtttaaaacaacgtacgtatcttagtttaaaaacatattattgctaaaaaatgctaatgatcatctgagccttcagagagtcataatgtttttgctggtggagggtcttgcctacttggcaatagctattgactaatcagggtggtggttgctgaaggttggagtggctgtgacaatttcttaaaataagacaatgaagtttttggcatcaattgactttgcctttcatgtagcatgcaatgctgtttgatagcatttacccacagtagaacttcttttacaattggagtcaatccttcctctcaaaccctgccacttccttgtcaactaagtttatgtaacattctaaatcctttttttacatcatcttcactagaattaggttccatctcaaggaaccactttctttgctcatcca

SEQ ID NO: 346651 - DNA, 778 bp, Homo sapiens
ctactgacctcagatgatccgcctgcctcagactcccaaagtgctgggattacaggcatgagccactgtgtccggcctcttttcttttttttggcagtatcctttgaagcacaaaagtttttgatcttgacgaaattcagtttatctatattttcttttgttgcttgtgcttttggtttagagaccgtatttttaaccaatacattatttgaacttgattctgtgagttatggaaagtgactgaaggacttaaagttgtagaatgacctaaaacttctcatttttaaaaatcaaactaatgcttatacatgtgtggcaggctaatgatgattcccaaagagatgttcatgttctaatccctagaacctgtgaatattatcttatttggaaaaaggctctttgcagatttaattaagaatctcgaaattagattatcctggattattcaggtgagccctacgtggcactaataaatccttataaaagaaaggtagagggagatttaacactcacagagaaggcagtgggaagacagaggcagagactacaatgatgaagccacaagtcaaggagtgctggcagccacccgaagctggaagagacagagaaccctagaggctctggagggaacatggccctgctcacactttgatttcagacttttggactccagaactgtaaaaaagtaatttcctgttgttttaagccgctaagtttatggtaattttttacagcagccataagaaactaatacagtatggtttttaaaaaaatcaaa

SEQ ID NO: 346652 - DNA, 188 bp, Homo sapiens
gaatgccagaataaatttaaaaaaccaccacccaaatatctgctgccttcaagagactcatctaacacataaggactcacataaacataaagtataggggcagaaaaagatattacacagaaatttaaaccaaaagtcagcaggagtacctattcttatgtaagaaaaaaacagactttaaagcaaca

SEQ ID NO: 346653 - DNA, 420 bp, Homo sapiens
ctgtaattgcgccactctactccagcctgggcacaacagagcaagaccatgtctcaagggaaaaagatgttcaaagagaagaatgattgtgagtagccatagcaatcctctaaatctagaaataatagactgttccgaagtctttatagaggttttttttttgtgtgtgtgcttttaaactataaactcaggttgtcagtataatggaaacaatttgtgacatttacagagaaattgaattttctttccacagtggatctggccttcaattctattagctgtggagcagtttgcctattacagtcttacagtagccactttttgtttttcaaaggatctgaaaaataagaatatgcttgtatagttttataaatgtaatcatcttaaatttgggtaaaatttgtttatttcagattattg

SEQ ID NO: 346654 - DNA, 3099 bp, Homo sapiens
  misc_feature (2719)..(2720): n is a, c, g, or t
  misc_feature (2947)..(2947): n is a, c, g, or t
acattccacagcagcgcgctcacgcgtgttcgcactcaggacagccacgcagctgctggtgtcgcccgtgtgctcctgcggtgtgggatggtcgcggtgtgggacggtctgcggtggtgtcttcgcgttccccagggagtgtgccctgtgcatctccatggtacctgaagtccaggaagctgcctgcggatgttgcagttgggattacggggcagatgcagtggtcggtaggagcgagtgttcggggaagctgtaggtgttcgtggcgcgttggctttctggtaattcctccggctgcactagacatgccgcactgtgtgtccttccgtagcattgagagagaagagggaggatgcccaggtaaaagatgggaaatagcctagaatatcaactgtgatggtccctggtggggctaatggtggcaaacttttctgcttttttgtaaagaaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacaggtacggggcctccgcctccggcacgggcagggctgccttagtctcccctccggacacgtgggtctgtggtcattctctgtggctgaggccgagtctcacggtgtctccctttcaaactgctcacacccgtcttgtgtttttgtctctggcacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggagcacacaggctcaccctagggacagccagggtccgcgcctctgtggggaaggtcggggggcataaaccctgtgggcagcaggcaccgttgcacaccgtctgcggtgggcatggatggcgccggagccgtgtccaggggagggagcaggccaggtgacaggggctgtcttgggccactgccccagtgagttgtggccagctaggaggggaaggaccctgggcgtgggtgccagaggaggccatgctgagaggcctctccaccggctcagcctcccgtggaccccagcctcccgcgccgcccttgctgcttgtccccatcccctctacaacttggttccttctgtgggggggcccagcccagcagggctcagtgacgtgatgctgtcacacggaccctgggcttccaccctgtccctgtgaggtgctgctgtggctagaagggtccccgtgggcctggggtcctgtctgcaccgaggagggcctggtgtgagttaggatgcagacgacagccaaacagtgctggggaaagcagggaggaccctgccctgagcagaggccatgcgcccgcctgtcctgttccctctgcagctgttctgggcaggtccataagaaggtgggttggggcctccgacccccactgctccgcctgcagggttgagaaacccagccccatctcaccacgggtccccacacctctgaggaggtctcagggcccccaatggccagggacccagaaggctcacctgcagccaccccacacatccctgccactgtgggcatcagaggccctctccctccagggtgcatctcctggtcaggaggggggaggcccggttgccttaggcccggcctgcacaggtcgtgaggaaaagcacctggtttcggccgggcgcggtggctcacgcttgtaatcccagcactttgggaggccgaggtgggcgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaggttgcagtgagccgagatcctgccactgctctccagcctggcgacggaggaatgctgtctcaaaaaaaaaaaaagcacgtggttttggagagatgtgtttctccctggatgcgggcccagcccaggtgtctgcaaggtgccctccctggtggccgagggtggcacagaggccccaggcagggagcaagtatcacagcagccaccccaggctcagcctcccaagtagctgggattacaggcacccaccaccacacctgactaatttttgtatttttagtnnagacagtgtttcaccacgttggccaggctggtctcgaacttctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatngcgagaccctatctctacaaaaaattaaaaaatgtgccaggggtggtggctcatgcctgtaatcccagcactttgcaaggccactgtgggacgttacctgagcccaggagttggagaccagcctgggccacatggcaagacctgctctcttt

SEQ ID NO: 346655 - DNA, 540 bp, Homo sapiens
  misc_feature (3)..(4): n is a, c, g, or t
  misc_feature (33)..(33): n is a, c, g, or t
atnngagtccacccaacggccggcagggtttcnccggaaccggtatgcaatgattcgattccagctgggcccggcagcattcaagagtcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagaccgctgctgaaaatgctcacgggtttcctctagagtccagtatcaccatgactacggtattcactggccgt

SEQ ID NO: 346656 - DNA, 1311 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346657 - DNA, 3004 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaatatattaaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatcttcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtggagggccctgggcagcctgtgtctggaattcttcgtcctgaggccgcctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccaggcccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccaattaaagcatttgcacagaaaaaaacggcctgccg

SEQ ID NO: 346658 - DNA, 1594 bp, Homo sapiens
  misc_feature (1324)..(1324): n is a, c, g, or t
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaaaaaaaaaaaaaanaaaaagcgaatgtgatatcaacaaaaagaaggggggggggttataaattttccgccggggggcgatataggcttcacccgattttttgtacaaaggggccctaaaggggaggtttaataaagaaggaggggggggttaaaagagtagtgcggcaacggtctgggttttgggaggccctttctgcggggttttgggaccccacgagattagggtgggattaattaggttgtggtaacgctttgtgtggagtgtgcttattatattgagacc

SEQ ID NO: 346659 - DNA, 1379 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgatatgcgtggctgggtgtgttagagtaataacgttttcaaaaaaaaaacccgggttttgcgggggggaaaggtgaggctggcaatggcgacactttgaagggactgggccaaaggggaataacg

SEQ ID NO: 346660 - DNA, 1130 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgctctggagatcctaatcgagatacgcttacaaca

SEQ ID NO: 346661 - DNA, 1373 bp, Homo sapiens
atagctaggtacgagccggtgttaatcggacgaggcgagacaagggatggcgcgcgcgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346662 - DNA, 2910 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaatatattaaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatcttcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtggagggccctgggcagcctgtgtctggaattcttcgtcctgaggccgcctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccaggcccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccaattaaagcatttgcacagaaaaaaacggcctgccg

SEQ ID NO: 346663 - DNA, 1227 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346664 - DNA, 2040 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaataaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346665 - DNA, 1729 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaataaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346666 - DNA, 1730 bp, Homo sapiens
acattccacagcagcgcgctcacgcgtgttcgcactcaggacagccacgcagctgctggtgtcgcccgtgtgctcctgcggtgtgggatggtcgcggtgtgggacggtctgcggtggtgtcttcgcgttccccagggagtgtgccctgtgcatctccatggtacctgaagtccaggaagctgcctgcggatgttgcagttgggattacggggcagatgcagtggtcggtaggagcgagtgttcggggaagctgtaggtgttcgtggcgcgttggctttctggtaattcctccggctgcactagacatgccgcactgtgtgtccttccgtagcattgagagagaagagggaggatgcccaggtaaaagatgggaaatagcctagaatatcaactgtgatggtccctggtggggctaatggtggcaaacttttctgcttttttgtaaagaaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346667 - DNA, 1982 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaataaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgtcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346668 - DNA, 910 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346669 - DNA, 2158 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaagtagctccctgttcagtgtcctggaagtcggcctgttcctgcggggattggagtcctctccaaagaggcccgtggctgtggccgtggcgccctggtccgggcgatccatggagctgggagggagtgagatcacagatttggaggtcggctttgatccctgatccccgcctcaggctgcagatgcgagtctgtttccagctccacgggtgggcggtgcacgtaatagacttagtctctcatcccagctaattggctgggaagctccagagtcctttgcagggagaggctgtgagatccaggctggagctcctgggctaggagtgcctggaccctcagtgattgttggcgatgaagacaggatttggtgcccacaagaccccagccctggatgggatggacgtgcagaagcgccaccactccgagtctcactggagggtttatcttgccccacctcactgctcttcctgtgggctctcgcagtctctcccacccggggctgcgtctgcagccgggcaggcatagagcaggggagcagcagagaaggcgcgagaagaaagggctgaggccaggttcgactttgagcctacagctaagttagtgatctcagtcagttcagcaaaactcaggagagggaggagagggccgccacgtccctgccgtcccatagctggaaatcggcaggccctttctgtggtgagttccactcatttaacacgtgcccagcacctagacagcgcctggccacggtgaggcgagagtgctgtgtaaaagcttccactgcaattgtcactcaagacacacaagtgttttccacagtggcagtgaccagaggagcttgaggactgctgacagcaccagctggtcgagacttgcttcatttttggattgtcctttgctgtttgattttttttttaaaccatgagcaggtattacttaagatgacttattttaattaagaaaaatataagaatgagacacagtagctgctttcattgattctgttcaaccgttgattggaattccaagcaaatgcagcaagacaagaaaaagaagtcacaacggaagaggtggggaggaaggccaggacaacagctcagtaaagctgaggtgcaaggctgggcacggtggctcacacctggaatcccagcacttttggaggccgaggtgggaggatcacctgaggtgaagaccagcctggacaacatggtgaaaccctgtctctactaaaaaaaacaaacaaacaaacaaaaattagtgggtgtggtggtgggtgcctttaatcccagctgctcgggaggctgaggcaggagaagtgcttgaatccaggaggcgggtccagtgagccgagatcgcgccactacactccagcctgggcagcagggcaagaccctgtctca

SEQ ID NO: 346670 - DNA, 1901 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaagtagctccctgttcagtgtcctggaagtcggcctgttcctgcggggattggagtcctctccaaagaggcccgtggctgtggccgtggcgccctggtccgggcgatccatggagctgggagggagtgagatcacagatttggaggtcggctttgatccctgatccccgcctcaggctgcagatgcgagtctgtttccagctccacgggtgggcggtgcacgtaatagacttagtctctcatcccagctaattggctgggaagctccagagtcctttgcagggagaggctgtgagatccaggctggagctcctgggctaggagtgcctggaccctcagtgattgttggcgatgaagacaggatttggtgcccacaagaccccagccctggatgggatggacgtgcagaagcgccaccactccgagtctcactggagggtttatcttgccccacctcactgctcttcctgtgggctctcgcagtctctcccacccggggctgcgtctgcagccgggcaggcatagagcaggggagcagcagagaaggcgcgagaagaaagggctgaggccaggttcgactttgagcctacagctaagttagtgatctcagtcagttcagcaaaactcaggagagggaggagagggccgccacgtccctgccgtcccatagctggaaatcggcaggccctttctgtggtgagttccactcatttaacacgtgcccagcacctagacagcgcctggccacggtgaggcgagagtgctgtgtaaaagcttccactgcaattgtcactcaagacacacaagtgttttccacagtggcagtgaccagaggagcttgaggactgctgacagcaccagctggtcgagacttgcttcatttttggattgtcctttgctgtttgattttttttttaaaccatgagcaggtattacttaagatgacttattttaattaagaaaaatataagaatgagacacagtagctgctttcattgattctgttcaaccgttgattggaattccaagcaaatgcagcaagacaagaaaaagaagtcacaacggaagaggtggggaggaaggccaggacaacagctcagtaaagctgaggtgcaaggctgggcacggtggctcacacctggaatcccagcacttttggaggccgaggtgggaggatcacctgaggtgaagaccagcctggacaacatggtgaaaccctgtctctactaaaaaaaacaaacaaacaaacaaaaattagtgggtgtggtggtgggtgcctttaatcccagctgctcgggaggctgaggcaggagaagtgcttgaatccaggaggcgggtccagtgagccgagatcgcgccactacactccagcctgggcagcagggcaagaccctgtctca

SEQ ID NO: 346671 - DNA, 383 bp, Homo sapiens
gttataaacaaaccacaaacatcagaatggtaacagactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccaattaaagcatttgcacagaaaaaaacggcctgccg

SEQ ID NO: 346672 - DNA, 1543 bp, Homo sapiens
  misc_feature (1391)..(1391): n is a, c, g, or t
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaataaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggtaaattcgaaccaccattatttcacccgaatgtgtacccttcggggacagtgtgcctgtccatcttagaggaggacaaggactggaggccagccatcacaatcaaacaggtacggggcctccgcctccggcacgggcagggctgccttagtctcccctccggacacgtgggtctgtggtcattctctgtggctgaggccgagtctcacggtgtctccctttcaaactgctcacacccgtcttgtgtttttgtctctggcacagatcctattaggaatacaggaattctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatngcgagaccctatctctacaaaaaattaaaaaatgtgccaggggtggtggctcatgcctgtaatcccagcactttgcaaggccactgtgggacgttacctgagcccaggagttggagaccagcctgggccacatggcaagacctgctctcttt

SEQ ID NO: 346673 - DNA, 1244 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggggtaaggggcgctgcggcctcctgcctgtcggggctcagcagatgcgtgcggcagtgccatggggatactccgctcagatccctgccgtccgtgacggccacccttgtcacaggccgcggtcaacagctcagatccccagctgtggcctggcccccgccccgtgaggacttgagctcagaaggtggtgctggcaaggttggggtgacagctgtgtccctaccgagggcatttctggttgagaaggaagcaggctgggcctggccgggcacagggctgagctgtggcagaggggaaggggctctgatgtgtgttgggagcaggcctgaggggcgggcagcctttgcgtgctggaacccgggattctgctgtgtccttccaggtgtggctcaggtcgcgggagctgggtttgcaggagagccaccccggcctaaaaccgtctactggagaacctcctggggcacagggactggcggcagccacctaggatgcctgcttggggccccgtgtgtctgtggcaagcagggcggcccatgtgcctgtcctctttgcccggctcaca

SEQ ID NO: 346674 - DNA, 1700 bp, Homo sapiens
  misc_feature (1548)..(1548): n is a, c, g, or t
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaataaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacagatcctattaggaatacaggaattctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatngcgagaccctatctctacaaaaaattaaaaaatgtgccaggggtggtggctcatgcctgtaatcccagcactttgcaaggccactgtgggacgttacctgagcccaggagttggagaccagcctgggccacatggcaagacctgctctcttt

SEQ ID NO: 346675 - DNA, 1846 bp, Homo sapiens
ggatgggaagcgagcatggtgagtcctcaagtcgcagctgggcctgccacgtgggagtggagggtggaggaacgtgtggagtttcggagtccagcccagtgcgagacagccttgaaaccgtggttggcgggcgctccactccgctctgggctcgaaccctgcctgaccctagctgtgccccccactttctccctgtctggcccctggctccccgccccctcacttagaggagggcacggggaagggcaaacggtccagagggcgggcggcctgcgggctcctctgcatcatgtgaggagggcgtggggaaggacatcctggtggggcccgatctggggctgcctccagcccgggcctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346676 - DNA, 429 bp, Homo sapiens
ctggggtgagggcacgggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagcccatctcaccacggtttatttccccacaggctgaggcaggagaagtgcttgaatccaggaggcgggtccagtgagccgagatcgcgccactacactccagcctgggcagcagggcaagaccctgtctca

SEQ ID NO: 346677 - DNA, 1161 bp, Homo sapiens
atagctaggtacgagccggtgttaatcggacgaggcgagacaagggatggcgcgcgcgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346678 - DNA, 2719 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaatatattaaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatcttcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtggagggccctgggcagcctgtgtctggaattcttcgtcctgaggccgcctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccaggcccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaaaaaaaaaacatttgcggccg

SEQ ID NO: 346679 - DNA, 1568 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346680 - DNA, 1303 bp, Homo sapiens
gagcgtcaccgtcctgcgacgcttcagaggatccttaggcctcagtggtctttggcccccggccccaggacctgaccccaaggaaacctccgggacctgtggctggagaggtgaccgccaggcatccggggagcctttggagatctcggcttcctttttcccccgctgcttgccggcgtgtcctcgggtggacgcgggcagcccgaaggggagtttacagacgctccctcacatcggggacgcggctcctttaagggcggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346681 - DNA, 1155 bp, Homo sapiens
gagcgtcaccgtcctgcgacgcttcagaggatccttaggcctcagtggtctttggcccccggccccaggacctgaccccaaggaaacctccgggacctgtggctggagagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346682 - DNA, 1253 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346683 - DNA, 1641 bp, Homo sapiens
atagctaggtacgagccggtgttaatcggacgaggcgagacaagggatggcgcgcgcgccgccccgctcggtcctccacctgtccgctacgctcgccggggctgcggccgcccgaggtgagcgcgtgcgggggccgggccggggccgcggggcgggggtcgggccgaggcctctactcctgttgggcccgggcccccgactgccccgcgccccgccccgccgagccgggccccgcgccgcggccgagctttccggggagcccgagaggccccgcgctcggcgccggctcggtccgcgctgctggcgccgctgggctgcggcccgagcggccgggccgccgcaggccttcggggccggggctcccccacttcgcccccgaggtgcgcctggcgcggggccggggcagccacctgcagccggggccccgcgaggccgcgccttcctcctgcgcggggagcggcttccggggtcacggtcgccccgcggacggataggatgggccgcggggggagagtcttggattgcaacatcgctggctcgcgggggtgggggccggcgagcgggcttgttttcggtgccttaaaaccaaaacaagtggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346684 - DNA, 1078 bp, Homo sapiens
ggcacgaggccgtgctctgcctcctgtgttccaggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346685 - DNA, 1234 bp, Homo sapiens
gcgcgggcaacggggagcgctcggcggcgcgggaggcgctcggggccgggcggcaggagcggcgcgcgaggcaggcgtgcagagggcagccccgcgttaggccccgccccgcgcgccccgcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaa

SEQ ID NO: 346686 - DNA, 2293 bp, Homo sapiens
  misc_feature (1913)..(1914): n is a, c, g, or t
  misc_feature (2141)..(2141): n is a, c, g, or t
ggcacgaggccgtgctctgcctcctgtgttccaggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggagcacacaggctcaccctagggacagccagggtccgcgcctctgtggggaaggtcggggggcataaaccctgtgggcagcaggcaccgttgcacaccgtctgcggtgggcatggatggcgccggagccgtgtccaggggagggagcaggccaggtgacaggggctgtcttgggccactgccccagtgagttgtggccagctaggaggggaaggaccctgggcgtgggtgccagaggaggccatgctgagaggcctctccaccggctcagcctcccgtggaccccagcctcccgcgccgcccttgctgcttgtccccatcccctctacaacttggttccttctgtgggggggcccagcccagcagggctcagtgacgtgatgctgtcacacggaccctgggcttccaccctgtccctgtgaggtgctgctgtggctagaagggtccccgtgggcctggggtcctgtctgcaccgaggagggcctggtgtgagttaggatgcagacgacagccaaacagtgctggggaaagcagggaggaccctgccctgagcagaggccatgcgcccgcctgtcctgttccctctgcagctgttctgggcaggtccataagaaggtgggttggggcctccgacccccactgctccgcctgcagggttgagaaacccagccccatctcaccacgggtccccacacctctgaggaggtctcagggcccccaatggccagggacccagaaggctcacctgcagccaccccacacatccctgccactgtgggcatcagaggccctctccctccagggtgcatctcctggtcaggaggggggaggcccggttgccttaggcccggcctgcacaggtcgtgaggaaaagcacctggtttcggccgggcgcggtggctcacgcttgtaatcccagcactttgggaggccgaggtgggcgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaggttgcagtgagccgagatcctgccactgctctccagcctggcgacggaggaatgctgtctcaaaaaaaaaaaaagcacgtggttttggagagatgtgtttctccctggatgcgggcccagcccaggtgtctgcaaggtgccctccctggtggccgagggtggcacagaggccccaggcagggagcaagtatcacagcagccaccccaggctcagcctcccaagtagctgggattacaggcacccaccaccacacctgactaatttttgtatttttagtnnagacagtgtttcaccacgttggccaggctggtctcgaacttctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatngcgagaccctatctctacaaaaaattaaaaaatgtgccaggggtggtggctcatgcctgtaatcccagcactttgcaaggccactgtgggacgttacctgagcccaggagttggagaccagcctgggccacatggcaagacctgctctcttt

SEQ ID NO: 346687 - DNA, 1635 bp, Homo sapiens
ggatgggaagcgagcatggtgagtcctcaagtcgcagctgggcctgccacgtgggagtggagggtggaggaacgtgtggagtttcggagtccagcccagtgcgagacagccttgaaaccgtggttggcgggcgctccactccgctctgggctcgaaccctgcctgaccctagctgtgccccccactttctccctgtctggcccctggctccccgccccctcacttagaggagggcacggggaagggcaaacggtccagagggcgggcggcctgcgggctcctctgcatcatgtgaggagggcgtggggaaggacatcctggtggggcccgatctggggctgcctccagcccgggcctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgaggtgtgtgaggttcgtgggcctccacaggtgtgggagccatccaggtccccagggcccttgtggctattctaggacagcccaagccgtagtagggacggccccccacagcttagaagacctggctcagtcccccagctttgtagaggtggcccttgtttggtgttgagatatcagacttgggggtagtagcttcagtgttcccatggactttgaaaaccagcacacacttaggtttgaattcttgggcaagttttgtatcttgagcgctgtttttcgtgggtaaaggtggccaccagtagggtgacagttgagggtggcattgaggctgctggccctgtctgcctggtgtccccagtgacagtgctggccgacaggctcccgccgagaacgcaaaggcgaaggtgccaagcccccgaggtcccgtgcagatgtgtggagctggaatctggcgtgtgtgccgctgcctctgatcagggacctggtcccctaccccatgctcctgccctgccctgcaggacccgtctgtcccctgaagccacagggacgtggtagtggctgcacggtctgggaagggtgtccccgtggagggctcctctctcagtgaggctgagcctctgccctgtggtacttgttctgctctgtcttcaacatggtgaaaccctatctctactaaaaatacaaaaattagctgggcgtggtggcacacgcctgtagtctcagctactcgggaggctgaggcaggagaattgcttgaactcaggaggcggaggttgcagtgagccgagatcgtgccactgcattccagcctgagcaatagaatgagactctgtctca

SEQ ID NO: 346688 - DNA, 480 bp, Homo sapiens
cttggaggtgaaactcttgaagggtttttatttagaaatcagattgtcagcatgtggtggcatcttcttaaacttagataacgggtccagagttgcctggctagttagtgtcaggttcattagactagatgcatctctcctggcttgccagagtctctaggtgtggttgtacattctgaatgcactgttttgagtattcagcacctgttgtgcatgtgtctctgcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactgga

SEQ ID NO: 346689 - DNA, 426 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaagatgatcccaacacctccggaccggtacagccc

SEQ ID NO: 346690 - DNA, 486 bp, Homo sapiens
atgcaacagagactatatgtggcccacaaagcttaagatatttactatcctgctctttacagaaaaagtttgtcgacctctgttttaggccaccctcacactgataccctggctctccaaaagattgttcttcataacacatttgggttcaaattcaacctgacctgaccttggtgataaacttgacttagactgacttgaagttttttatcattgttatttagtatatttgacatgaatattcatgttttgtggattttctgttatcctcttgttaatgatttctagcttaatttcactgtgatcagagaatatattctgaatgattccaatcctttgaaatttgtcaaagtgtgctttatgattggtatatggtcaattttggtatatgttttatggctttttgaaaagagtgcactttctgaacttgctggatcaacatctacatatatatcagttacatcaagtttgttaattacattattc

SEQ ID NO: 346691 - DNA, 4362 bp, Homo sapiens
cagtggtggcggtggcggcggcaccacacaaaaccctcgggaaacatccagaacgtgccgcgaaccagccggcagggtggggcgcagcccggctgcaaacatgccagcaaggaggcagtcccaaccccgcagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346692 - DNA, 2692 bp, Homo sapiens
cgagctgcaggtaactcaggggcgagctgcaggtaactcaggggcgagctgcaggtaactcaggggcgagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346693 - DNA, 2423 bp, Homo sapiens
atacggctagtacgagcctgggtgttgaatcggccgaggacaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346694 - DNA, 4517 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgacaaaaaaaaaaggggggggatcttaaaatttcactgaggggcaaggttaagcgtaccagtttggtaaaagggcctataggagtgtttaaaaaggaggcggagtaaaggtgaggaaaagatggaatgggagaaccttgggggaaaggaacaagaataggaggaaaaaaggaggaaagtaa

SEQ ID NO: 346695 - DNA, 3109 bp, Homo sapiens
gctaagcgtttaaatagagtttgtagatgtgtttgttgcaaaaccctctcccatccaaatcacaggcgatcctgtcaactgttgtctgagtccaggaggaccccatgtggcacatggggattgggggtatcagtaattctgagtttggaagcagcagtggtttacagtcacctccacccccttgcctggcatctttgctttcagatctatgtcaagagatactcaaggacctccttccactctacccttgagcacaccatctccccagttgtcctccagacatttcagtgtgttccacagagtttctctcttatgacaagaaccccaaagcccatgtctctctgtagtggacaaaccacctcatctggaaaatcttgattttgctggaagaaccttgttagtttctgttagttacatctgaggcaaccaattctgctgccttctatcttctgtggagccagttcttgagctgattctgaagcaacaatgttccaccctggagatcccagccaaggctgatgaagcctgcaagcgacaacctggtaactcttgactgtccaacacagataaagtgctttttctggctggcaaattaggtaatcccaagaggaaagcatccaggatgaccaaactcatttaacctgattcatatcttcccccagtagtacctgtggattgacagggttgcaactgacacagcgattactgctaagctgcgaagttgaggtttgttgcttctgctccacaaatataagcaaaataataatgatgatgataatgaaatagcactacctatagaaatccctaagcttgggtttaaatgaagaaagttagggttttatttttaagtattttatatccaacactaaagtgtctgtatgtgtgcagtctggttgtattttctttgtaatcatcgctgtttatcaatgtttagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346696 - DNA, 3459 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactgga

SEQ ID NO: 346697 - DNA, 2424 bp, Homo sapiens
  misc_feature (20)..(20): n is a, c, g, or t
ctctgctggtaccggtccgnattcccgggatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggccacagaaagtccagaatttctaccttgttcctagcaagaagagagatcagtgtttaaggttcaggccacctcttccatagatgttttactgcatctgccatgactaggagcctgggattgttggaagtccactcctctaagcgaggatgcaagaaggattcaagaactgaaggctagtagacaactccccagccaacatccgacatgcccttcagccagtagaggtagctgttgcatcaactagctccccagccttgtctgcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346698 - DNA, 3249 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcaggtaaagatttataaaaagcgaaagcaatatattaaaaaaaaaa

SEQ ID NO: 346699 - DNA, 1502 bp, Homo sapiens
tgaagagtgtgtgtctaggttttatttcaaggatttgatgagtttggtttgtggcttgtttttagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346700 - DNA, 3164 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataagtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcaggtaaagatttataaaaagcgaaagcaatatattaaaaaaaaaa

SEQ ID NO: 346701 - DNA, 2956 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtaaaaagtttgtcgacctctgttttaggccaccctcacactgataccctggctctccaaaagattgttcttcataacacatttgggttcaaattcaacctgacctgaccttggtgataaacttgacttagactgacttgaagttttttatcattgttatttagtatatttgacatgaatattcatgttttgtggattttctgttatcctcttgttaatgatttctagcttaatttcactgtgatcagagaatatattctgaatgattccaatcctttgaaatttgtcaaagtgtgctttatgattggtatatggtcaattttggtatatgttttatggctttttgaaaagagtgcactttctgaacttgctggatcaacatctacatatatatcagttacatcaagtttgttaattacattattc

SEQ ID NO: 346702 - DNA, 2700 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtgtaagactctgtcaaacgttgcatttgaagggaaagccatatcctatattctctgtgcctgagcattttttaagttgagttctttatttttaccagttgtacatgcatgtagttttaaaagtcatgtaatttgacaagacaaaattaaaacttttaattaaaaattta

SEQ ID NO: 346703 - DNA, 1903 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccggtaattgagtctttgcctcggctttaggcgctggttagaaaggctccttgtttttctctgtttcactcaccctctttggtgatttatgccttaaagttatttttaaccctagtgttttagtttaatttcagatttaaattctgcctttgtatgtccacaactctcgatatatctgtgcacacttccaacactaaatgcaaaaacttaaatttaggaatcgctcaagcaattctttattgaaagccaaggcggcaaatggataggccgcagccagagccagccccagatgcagttgatttggaaaataccttgttgtatatgttttaaaaaaaatcagttatctaaaaagcttgtatgaaaatgcaaatttctagctttttaaaaaaaaaaaa

SEQ ID NO: 346704 - DNA, 1063 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccaggtatctgtatgcacgctt

SEQ ID NO: 346705 - DNA, 315 bp, Homo sapiens
atgcctccagtggagaaaacacaggcattgtcaagaagttcccgaggtttcggaaccgagagctggaggccactcgacgccagaggatggattacccagtgtaaggatgggtagcagaagggagctgatcgggcggtgcttgttttatttgaggaccagagcaggctagtggaagaattccttaggaagacacaccttcttggtaaggtgttttgcaaaaatgttgagatttccatggcttagacagaattggtggacctgaaaacctcaaatgagtcttgaattattcttggcatttaacaatcctcaatttgc

SEQ ID NO: 346706 - DNA, 314 bp, Homo sapiens
gagtgtgccactgcactccagcctgggcgacaggccaaggctccgtctcaaaaaaaaaggcaagttaacatatttctggaatggctaggattgtatataggaattgggcctgacaacctttcagtgttaggattttatgaccctatctacaatctcatgaacgctttgtcaatttcttcctaacagggcatgttgtatagtttggttggaggccaggggagtgagaggctgtcttcaatgaatcttgggtataaacactaccagggtattgacaactaccccctggactgggaactgtcgtatgcctactacag

SEQ ID NO: 346707 - DNA, 481 bp, Homo sapiens
aaacacacctgggaagactctcaggcaggcttgtgttttctagcacttagcttttctttaatgccatctgctccaaaataagagaaagggaaggttttgttcagacttaggcagaatgcttccacaataattgcttccagagctctctagatttcatttttctaaagttaatttctttcttgttccaaaattcagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaagtgagtaggacttgagacccactctgcaactagtcagtcacttgatcatgaagcatttgttgaaggtacactgtgtgcaccagacccaaccccagacacagtccctgtc

SEQ ID NO: 346708 - DNA, 514 bp, Homo sapiens
tggaagataaagtgtatctaatccttggttctcaatctaaaacatcgtaaagtaggtttgctctcccacctttcaaaatcttgtgttaagcattatacaggaaaagtcattgttctaaattgctattatctttaagcaacgattggcccagatgctgttctgggggcagcaaggtgtggccaagaatcccgaagcagcaattgagtggtacgccaagggcgccctggagacggaggatcctgcgttaatctatgactatgccattgtgctattcaaggtaagaatcacttaattcgtgctgaaattgtgcaattcttatcagactcctgagcagtttcctgtgggcgggctggcaaacagggagtcgataactgaagaaatttagtatatgcttctgtcactcttgatggaaaagaatgttggctaaaaaggcagagtcagaagcagttccctgttctcatttttaatcattagtcttatgtttggcacctggattctctgtgctttcgcaaga

SEQ ID NO: 346709 - DNA, 4339 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346710 - DNA, 3768 bp, Homo sapiens
ctgtattgcgtcatgagctgatctagaggataccgaagatgcacgatggcgcgtcccccagggcctcggcggccgctctgcctgcgcgctgctcctgctctgctacctgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgac

SEQ ID NO: 346711 - DNA, 4265 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgca

SEQ ID NO: 346712 - DNA, 4361 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgacaattgactaccagaaagtggtt

SEQ ID NO: 346713 - DNA, 4380 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaactgaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgacccatgctattgaaacttctaaaactaggggggatcctctag

SEQ ID NO: 346714 - DNA, 3231 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaagctggagccacagtaaacagatggagtccttcagcacccatgcatccatatggccaaggcatttacacatgcacattgcggcattcatcatggggtgcataatcacatgcaagcatcaagaacacatgaatcatacatattcatgggaaccatttcatgcataatcacaataattgaattatcctcggaggggagtcatgaa

SEQ ID NO: 346715 - DNA, 3418 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaagatctactttctgggaacctttctgctatccatattgatcgcctggactgtgcagtatttccagtctgtctcagacccccaggaacaaaatataacagagtagtgtaaaagtttgtcctctccagcaatctcatggcaaaaaggctcgaaagcacaactgtgcaaacacatttgaagacgtccatcatgtcacttccactgagatcccactggcgaaagcaagtcacatggggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgta

SEQ ID NO: 346716 - DNA, 2412 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaagcaaaaaacaaatcaacaccacacaaactttttggggcgccttgggcccgaaaaagttttataccacactctgtggggcccgggccccagggttgggac

SEQ ID NO: 346717 - DNA, 2049 bp, Homo sapiens
ctgtattgcgtcatgagctgatctagaggataccgaagatgcacgatggcgcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcccctgagttacagctcgcccctgag

SEQ ID NO: 346718 - DNA, 503 bp, Homo sapiens
gaaaatgatgggtttaaatgaaatggatcctgttgacagtaaattttcttattctgttctttaggaaccggcgaatatttggcttgttgatgggtacccttcaaaaatttaaacaagaatccactgttgctactgaaagggtatttatccaagttttgttttgcatcatatatttaagttatcaaagtagtagattaatgtttttttaaaaaaatccttaaagctcttttaagacctaactgtaaacctgaaacaaagccaagtaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagtgctaagttctagttagttggtatcctgaattgaaaatgtgagccactgtgcccggcctgcagatacctttacatagtg

SEQ ID NO: 346719 - DNA, 823 bp, Homo sapiens
  misc_feature (819)..(819): n is a, c, g, or t
  misc_feature (822)..(822): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgagaagaatggatgacatatgccaaatattaattttagactaacaagccattgttatatctgaaaaggcagttccaactatgagntcna

SEQ ID NO: 346720 - DNA, 457 bp, Homo sapiens
tatcttgttctaggctttattttcaaaccctagcttactgctgatacacaatggaagctctaaaagattgctggattaaagtggtagcttgagttaattaatacactgggcccactaattctttgtacaaggaagatagatgcctggctgagattatttaaagcattgtttctgtgggaaagtgttttgtttttttgtttgtttgggacggagtctcacttctgatgtgatcacgttaaaacggtgtaaggcacattacatcataggttaaaaggcctagaaaactccgcgctccccttgccagaactgcagactcgcgagcctaagtctccgagaactcagggattgtgaaacccgccccgactctgcgctagcagcgggatccaggcacccgcagctaactggggagggagatgactgcctggctgacttttcattggctcagagtcacaaaggc

SEQ ID NO: 346721 - DNA, 3799 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgtgactgcttaagactagtacttgtattaactttctgatgctttatacaagagagcacttaaattgcatccttctttgagtttaacactgtagctttagccttgactttgaatattcattttgccttcccttgacaagtaaatggttacagtgaaaatgtgaagaagtatttccagttagtttttgtgtgtatataactcacttgtgtaagtggatgtgttaaaagatctctttttaaaaatccttttattggagtaattattaaaacagtaaatgcatagagctttgcacagcaatctgtatccatgagccagttccaccactagtaccttcatctgtggcttatccagcaaaatgtttcatttcctgtgtgccctggcaggaaagaggttggtaaatagtgaattaaagggatgatcataaaatttaacctggttaaaaagcaccttatttgatgacagtttgtatgcactaaaatcctttatac

SEQ ID NO: 346722 - DNA, 3313 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346723 - DNA, 3830 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtgaaaaaaaaaaacacaaaccccaacaaaaaaacaaaaaaaacaaacaacacaccaccacaccaaccacaaaaacaacaacaaacaaaccacacgcaaaacaacacaagacaaacacacaacaaacaacagagcgggggggggggggcgagagatatatgtgactactaggggggcggggacacgtagaacagaacaagccagacgagttgttgagagaaaagagaggagcacgccaaacagaaggcaaggagcgtataaaaaaagagcaagggcagagggcggcgacctgcggcagactcccacacaccaacaacggagatgggagaagacaaaagacaaacaggcggcgcgagaccacggtcggggaggggaagcgcaaccacaacacacgcaggacggcgcaaggaatgaggagcggagaacgacgcgacgaagaagagcaagagcgccgcggagcaaagaaagataattagacagcgaagggctgaggctgaggaccaacaagcgagaagcgtgg

SEQ ID NO: 346724 - DNA, 2487 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatccc

SEQ ID NO: 346725 - DNA, 1636 bp, Homo sapiens
cctgtacaagtggcagcagcagcagagatagtagcagtagcactagtagtggtagtgagggtaggaaggttgtagggaaggttgtagggtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346726 - DNA, 2803 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtactacctggtggggtgattcctgcatcccgggatggtctcgtgagcctggtatataactatccccttatcatggcagcttaacactagaatcggccgtaattgaggtctggagggtgcctgtagactggcttgacagttaagctgcccagctagctttgcgcttagggggaaatgccttaaacaagggaatttcctgtatcaggttt

SEQ ID NO: 346727 - DNA, 1443 bp, Homo sapiens
gaaaacatcaattgagaactaggaagtactccagcagcagccggagtcacatgggagcctacagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346728 - DNA, 1829 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagcgcctgggtgcagaagtgcgcctgggtgcagaagtgcgcctgggtgcagaagtgcgctgggtg

SEQ ID NO: 346729 - DNA, 1229 bp, Homo sapiens
caggaatgggatggcggtcttgtaagctcccctcttgccgcgtcctaggaacggcggaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346730 - DNA, 908 bp, Homo sapiens
gcacttgtataataatgaaataaacacacatttatttctacaaaagcaatgtatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346731 - DNA, 804 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatcgccggtcacgagatggtaccgagctcgattcactgccgtcttcc

SEQ ID NO: 346732 - DNA, 938 bp, Homo sapiens
  misc_feature (938)..(938): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataaatgccataatagtctttgccgctggaagcaggggtgggctagccctactagtctcaatctcaaaaatatgggctaaataagttaattactaaactatcaatgttaaatatcggcccaacattattttttacccttggctgatttcaaaaacctaattggttaaaacccaagctattagan

SEQ ID NO: 346733 - DNA, 699 bp, Homo sapiens
  misc_feature (693)..(693): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgcgctttggaacaggtgagcttgcgcagtgcaagaagatggaatgcantatgcc

SEQ ID NO: 346734 - DNA, 712 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaaaaactaagccaataaggccaggcacggtggctcattgcttggaaatcccagccatttagggaggccaagggcgggccagattaacctggaggtccagaagttccgaaaaccaggctgggttaaccattggagaaattcccggtctcttaattaaaaatta

SEQ ID NO: 346735 - DNA, 515 bp, Homo sapiens
  misc_feature (463)..(464): n is a, c, g, or t
  misc_feature (498)..(498): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaannaaaaaaaaaaaaaaaaaaaaattttgggggggtngggcctggaaaagtttt

SEQ ID NO: 346736 - DNA, 631 bp, Homo sapiens
ggggagggagatgactgcctggctgacttttcattggctcagagtcacaaaggctgcaggttcttcccccttccggtcgctgagtggttgaggccggaagacaacgctcatcgtcattggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggtaagggcctaacgggaactcggaactcggagctcggagaggcagccctcaggtcggggtgaattgggggcggggagggcggccagccttaagaagactggaacctcgaggcctgttcgcggggcggcgggtaaaaccctgttgtcgccgaggtggagaggccccaggtcccctccgtagagcgctggtctcaggtccctgaggaaggagagcgaggcctgggtgcgccggcatgctttcttggcctgtgagaagacccggactgctgattcccgctctcggccctgcaggcccggaactgcagca

SEQ ID NO: 346737 - DNA, 3104 bp, Homo sapiens
  misc_feature (2974)..(2974): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagcggccgcgaattcgcggccgcgcggccgcgaattcgcggccgcgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttntgtgcttccttcccctcaggtagcctctctccccctgggccactcccgggggtgagggggttaccccttcccagtgttttttattcctgtggggctcaccccaaagtattaaaagtagctttgtaattcc

SEQ ID NO: 346738 - DNA, 3070 bp, Homo sapiens
tggatctttctattttattagattaaaaaacacaacgaaacctgtaagaactaggggaaaaggaaaaagaaacagattaggcaaagatcagagctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346739 - DNA, 3256 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagtattgtatggaagtccacaaaatgaaggaagttcatctaggttttaatatgtaagcaagataacacacaagtgtaccaagtgattattaactttgttgttttacaaatttgtatgaacttggagtatctgttggccattactatacatgtgcaaataaatgtggcttagacttgtg

SEQ ID NO: 346740 - DNA, 2673 bp, Homo sapiens
  misc_feature (2621)..(2622): n is a, c, g, or t
  misc_feature (2656)..(2656): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcannaaaaaaaaaaaaaaaaaaaaattttgggggggtngggcctggaaaagtttt

SEQ ID NO: 346741 - DNA, 2384 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccaga

SEQ ID NO: 346742 - DNA, 2347 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgctttatttgaaggtagacgcatcgaatttgcagaacaaataaataaaatggaggctaggcctagaagacaatcaatgaaggaaaaagagcatcaggtggtgcgtaatgaagaacagaaggcggaacaagaagagggtaaggtggctcagcgagaggaagagttggaggagacaggtaatcagcacaatgatgtagaaatagaggaagcaggagaggaagaggaaaaggaaatagcgattgttcatagtgatgcagagaaagaacaggaggaggaagaacaaaaacaggaaatggaggttaagatggaggaggaaactgaggtaagggaaagtgagaagcagcaggatagtcagcctgaagaagttatggatgtgctagagatggttgagaatgtcaaacatgtaattgctgaccaggaggtaatggaaactaatcgagttgaaagtgtagaaccttcagaaaatgaagctagcaaagaattggaaccagaaatggaatttgaaattgagccagataaagaatgtaaatccctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcatggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccaga

SEQ ID NO: 346743 - DNA, 1047 bp, Homo sapiens
  misc_feature (1041)..(1041): n is a, c, g, or t
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgcaaaagcggcgccaggaaattgaacaaaaacttgaagttcaggcagaagaagagagaaagcaggttgaaaatgaaaggagagaactgtttgaagagaggcgtgctaaacagacagaactgcgctttggaacaggtgagcttgcgcagtgcaagaagatggaatgcantatgcc

SEQ ID NO: 346744 - DNA, 996 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatcgccggtcacgagatatctcgtgaccggcgattatttcgggaactatttagttgatgcagcctccgatcataatgggtgtcactattatgaagatgattacatcatgcagtgggctgtgtacgattatgttgtagatttggactgaaacacatataatgtcgcctggctgggctgtgacgattcgattatagatgtgtacagctgcgacaaggattccaggttatgcccagaataat

SEQ ID NO: 346745 - DNA, 942 bp, Homo sapiens
tgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacattcgcaagctcaccgggcgggatccgaatgacgtgaggcccatccaagccagattgctggccctttctggtcctggtggaggtagaggacgtggtagtttattactgaggcgtggattctcagatagtggaggaggacccccagccaaacagagagaccttgaaggggcagtcagtaggctgggcggggagcgtcggaccagaagagaatcacgccaggaaagcgacccggaggatgatgatgttaaaaagccagcattgcagtcttcagttgtagctacctccaaagagcgcacacgtagagaccttatccaggatcaaaatatggatgaaaagggaaagcaaaggaaccggcgaatatttggcttgttgatgggtacccttcaaaaatttaaacaagaatccactgttgctactgaaagggtatttatccaagttttgttttgcatcatatatttaagttatcaaagtagtagattaatgtttttttaaaaaaatccttaaagctcttttaagacctaactgtaaacctgaaacaaagccaagtaaaacttggtttaacttcttatagaacagctttacttaaacattgtgttggaatataacagttgttgatatcatagctaatagccttgaaatttagatatgtgaaaaaaaaaagcctcaagtctccatttccttaaagacaaattacagtcagtaccaagtgctaagttctagttagttggtatcctgaattgaaaatgtgagccactgtgcccggcctgcagatacctttacatagtg

SEQ ID NO: 346746 - DNA, 606 bp, Homo sapiens
  misc_feature (600)..(600): n is a, c, g, or t
gcggccgctccaacatcagaatggtaacaggatcaaaatatggatgaaaagggaaagcaaaggaaccggcgaatatttggcttgttgatgggtacccttcaaaaatttaaacaagaatccactgttgctactgaaaggcaaaagcggcgccaggaaattgaacaaaaacttgaagttcaggcagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatgccaaaataattaaatatataagaactaagacaaagccccatttgttttatattcctggaagaatgtgtccagctacccaaaaactaatagaagagtcacagagaaaaatgaacgcaaaagcggcgccaggaaattgaacaaaaacttgaagttcaggcagaagaagagagaaagcaggttgaaaatgaaaggagagaactgtttgaagagaggcgtgctaaacagacagaactgcgctttggaacaggtgagcttgcgcagtgcaagaagatggaatgcantatgcc

SEQ ID NO: 346747 - DNA, 3672 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346748 - DNA, 4161 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaaaaaaaaaaaaaaaaaaaaaaaaaaaaaaaaaaaaaaagcagaaaaaaaaaaaaaaaaaaaaaaaaaaaaagaaaaaaacagcagaaaaaacgaaaaaaacaatacaaaaaacacaaaacagaaacaacaccaaaaaaagaacacatcacgacgccacgcgggcgcggcgcccactacaaacgcaatctcccattgggaggaagacaacccaacgacgagacgaccacatttgggcacaaacggacggggaaccattagaacgagaaggcgggaacaaaaatctacgcaaagcacgaggccgcgccggtaaacaaacggataggcgaagcgaggccaaaaaccaaggaaaggcgacaattgaagcgagaaacacaccacccacggggccggagcgtacacccacaaaacaaccaactcgcagaacaacgaagccaaccgcggagcacactagaacccacaggacgaaggcgaaagagcacacacacacccacccgcccgcgcgagagagaaaacagacagcacgaaacgcccaaaaaaactacacgggagatgcaa

SEQ ID NO: 346749 - DNA, 2000 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgagga

SEQ ID NO: 346750 - DNA, 3839 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatggtgagtatgtcttatttttccagattttaatttgagtccccaatttccagaattctttaacctctcaggattccacctaaggtgaaaattgtggctactggggatggatcttcacgtctgtcctaaaaaatgagcaactatctgagtcccttcatctcttccccagccctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346751 - DNA, 3627 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346752 - DNA, 3565 bp, Homo sapiens
cccgcctcctacggcaagtcggaggtagcaagatggccgccgctgaggaaggctgtagtgtcggggccgaagcggacagggaattggaggagcttctggaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346753 - DNA, 1852 bp, Homo sapiens
  misc_feature (1800)..(1800): n is a, c, g, or t
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccattttacctcctctcttttttaaacacctgtttatcccaacntttttgagctcaaatggttacctgcttcttcctacattgcggggatcctcta

SEQ ID NO: 346754 - DNA, 1228 bp, Homo sapiens
  misc_feature (1211)..(1211): n is a, c, g, or t
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcctttgtgcanccggatcctctagacga

SEQ ID NO: 346755 - DNA, 2625 bp, Homo sapiens
  misc_feature (19)..(19): n is a, c, g, or t
  misc_feature (78)..(78): n is a, c, g, or t
  misc_feature (109)..(109): n is a, c, g, or t
  misc_feature (113)..(113): n is a, c, g, or t
  misc_feature (115)..(117): n is a, c, g, or t
  misc_feature (130)..(130): n is a, c, g, or t
  misc_feature (148)..(148): n is a, c, g, or t
  misc_feature (180)..(180): n is a, c, g, or t
  misc_feature (185)..(185): n is a, c, g, or t
  misc_feature (198)..(198): n is a, c, g, or t
  misc_feature (210)..(210): n is a, c, g, or t
  misc_feature (240)..(240): n is a, c, g, or t
  misc_feature (244)..(244): n is a, c, g, or t
  misc_feature (257)..(257): n is a, c, g, or t
  misc_feature (276)..(276): n is a, c, g, or t
  misc_feature (279)..(279): n is a, c, g, or t
  misc_feature (294)..(294): n is a, c, g, or t
  misc_feature (326)..(326): n is a, c, g, or t
  misc_feature (355)..(355): n is a, c, g, or t
  misc_feature (405)..(405): n is a, c, g, or t
  misc_feature (446)..(446): n is a, c, g, or t
  misc_feature (449)..(449): n is a, c, g, or t
  misc_feature (472)..(472): n is a, c, g, or t
  misc_feature (486)..(486): n is a, c, g, or t
  misc_feature (493)..(493): n is a, c, g, or t
  misc_feature (508)..(508): n is a, c, g, or t
  misc_feature (528)..(528): n is a, c, g, or t
  misc_feature (571)..(571): n is a, c, g, or t
  misc_feature (606)..(606): n is a, c, g, or t
  misc_feature (728)..(728): n is a, c, g, or t
  misc_feature (751)..(751): n is a, c, g, or t
  misc_feature (754)..(754): n is a, c, g, or t
  misc_feature (756)..(758): n is a, c, g, or t
  misc_feature (761)..(762): n is a, c, g, or t
  misc_feature (767)..(768): n is a, c, g, or t
acgtgggcttttttatttngttgagcgtcctgccacttagagctggtcggttagcccttttccttaattagctgggtntattttttgcatggcgttttgtttaggttangtgncnnntcccttttcctcntttttgggcgccgttccntttacggtttccgttgagctttttgttttttnggttnttgtgtcagtggngtgtgtttttcntgttttttctttctttttgctctccggttnttcngtgttatcttttngtctcttttgtgggtatgntcntggtttttcatcctnttattctcaccgcatggtttttgtttttagtncgactttgttttgcgtccttgtagtgttntggtatgcctcgctccggcattgttaccttgtgttccactttaccatttnatttttgctgctcctgacgcactctcattttcccatcacgnggnttcgttcataggggggttggtgncttttgtcatgggntgctggntgggtttaggccaantctccgctcccctttttcgngttattattggtcaccttgtttttaatcttttttccgggctgnggatcggttggtgtctggggttggagactggtggnttttcggtggtgtgttttttcccgcggtttttcagggccgagttttttctgtgccatgttttctccctcatttgggcatggtattaggggtactatctaggctttcagtcttgatgcgttcnaaggggttattggtaggatcgcnccncnnnggnnccgtnnaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346756 - DNA, 1846 bp, Homo sapiens
ggctggtactggtctggagtgtagggattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346757 - DNA, 1287 bp, Homo sapiens
cggcaccgttactcctcatctttaagcctccagaaacactatttcaaatgggataaccagtgcatgaagggagatagtaaggcagaagagaggagaacaatatacagagtaggctataatgtcaaagtcagaggttgtctgccaatgttatccacaaaaacttctcaaagctcacaagtaatatgtccaatgctgtccatctgacccatcttgatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346758 - DNA, 384 bp, Homo sapiens
  misc_feature (364)..(364): n is a, c, g, or t
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaattcacttcttgcctaanggcactccggattacgccct

SEQ ID NO: 346759 - DNA, 3882 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaaaactcgtgccgaattcggcacgagccacctcaggctgtgagaccttttacctcctaaccctgttctccagaccgttgtagaaaataaaatagcatgtctaattcatatccacgtaggagcacaggtaagtggcttttacttggttgtaataaactactactgtgcagaaaattgtgtatagaaactacataatgaagttacataattactcatttgtatttagattatatcaaccactgtgaaaattatagcttaatttttactaaaagtctcaga

SEQ ID NO: 346760 - DNA, 3646 bp, Homo sapiens
acccacgcgtcgcccacgcgtcgctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346761 - DNA, 3674 bp, Homo sapiens
ttatctgcagagatcaggccaaagggagctctagaaggttgttggggagcactaaactggagaataagagaagatagtttaatgccgtaccatggagtctggtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattggg

SEQ ID NO: 346762 - DNA, 1439 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctattgtgattagatgcaaaagccctttccctttagagaattcagaatggtctgtctgaaggcaagagagcatagtgacaggtcga

SEQ ID NO: 346763 - DNA, 1549 bp, Homo sapiens
agctgccgctcgcgatctagaacagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccacccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgagga

SEQ ID NO: 346764 - DNA, 277 bp, Homo sapiens
aattgaagtagtaaccctttcttgggtgttcaatgatattgtgcttctcttcatgtaagtgccccttagattcctcctcctcactaccatcaggtcatagaatagggaggggcactcagtttcaacagcagtggcctccaaattttgttcaaatgcataactataaaaagttttttgtatacattctctatatatagctatacattttatacatacactactatcagtcttgatttagacattactaaagcttaatttttctctcattttttttcag

SEQ ID NO: 346765 - DNA, 1979 bp, Homo sapiens
cccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgttaaaaattcagattgaactatcttacaaatggctcccagaagatccactccctgtgggaacacagcagttgtggaagtgaagacaggactggacccagaataagggttcaaatatgtggggaaatctgacctctaaattcttataagtcagagagtgactgaacaacagcagtgagacatcgaagagttttaatatctgctgtaaaccttggcacagatcatttacttctctaagactgaatccaaaaagcacaatggaatactataataagctgagacagcatggtgaattccagacaagcctgagcattccctatagccagagaaggaggcccaacacctaacatagccttggatgcagaactgatagaacttggggaaagtgatgaagtagttgacctcacctgtgaatctctagcacctgtagtgattgacctaactcaccgtgactctgtagtgattattgaacaaaggaggaggccaagagcaaacacaaggccactccaagaccacactggcagttgtgtggtgaacaatgatgaggagggagtgaaaagggacagagatgtatgtataaccaacagtgcccaccataattccctgcaaaaaaattttttttgtcatatactacctggttatattcagtgtcaagtttgcatggatggatgctcagagattgaacttagtatacaacacatctactctatagaatgtggccacatctgtagtcagtgcttctgcacttcctttacacatactaacactgcccagtttgtttgaaaaaaatcagcctccatcagtatcactgcagttatatatgatgtatgccttattgctcaagacagatcctgtggctggatttttccatgtctttgtgcaggaactatgggttgttggcatccaatgctctgagcttaaaaatactgatttttaaaattgctatctgcagtatataagaaactctttgatttctcatatgctctgagactgctttttgtttcctttggttttatgcttcagctctggacttcagttgccagagtgtgccagatactggggtcgtccttaaagcaactttccctttcttatagtcatcaatttttagttggccacatgtagacattctggaccacataaataaagacaacaccctagagatggtgaagtaagttgtaaactaaaatcctaagccccctaattgactgaatggaacccctcttgaccaaagtgaccccagaaaaaccttaaaactgagttcctggccatgacgggatgggaggtcagacacgcttcattatatctccgtctcttttatggtttagacacagcaactgaccagcattaatgtcaaaataaagatcataaggctgacagaatagaccctttgtggcaataacaaattattcgtaagatctaaggtcatgccaggcaagtgttatgtcatgcactcctacacttaaagaataaactatgttctaactgccaaaaaaatt

SEQ ID NO: 346766 - DNA, 1963 bp, Homo sapiens
cccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgttaaaaattcagattgaactatcttacaaatggctcccagaagatccactccctgtgggaacacagcagttgtggaagtgaagacaggactggacccagaataagggttcaaatatgtggggaaatctgacctctaaattcttataagtcagagagtgactgaacaacagcagtgagacatcgaagagttttaatatctgctgtaaaccttggcacagatcatttacttctctaagactgaatccaaaaagcacaatggaatactataataagctgagacagcatggtgaattccagacaagcctgagcattccctatagccagagaaggaggcccaacacctaacatagccttggatgcagaactgatagaacttggggaaagtgatgaagtagttgacctcacctgtgaatctctagcacctgtagtgattgacctaactcaccgtgactctgtagtgattattgaacaaaggaggaggccaagagcaaacacaaggccactccaagaccacactggcagttgtgtggtgaacaatgatgaggagggagtgaaaagggacagagatgtatgtataaccaacagtgcccaccataattccctgcaaaaaaattttttttgtcatatactacctggttatattcagtgtcaagtttgcatggatggatgctcagagattgaacttagtatacaacacatctactctatagaatgtggccacatctgtagtcagtgcttctgcacttcctttacacatactaacactgcccagtttgtttgaaaaaaatcagcctccatcagtatcatgtatgccttattgctcaagacagatcctgtggctggatttttccatgtctttgtgcaggaactatgggttgttggcatccaatgctctgagcttaaaaatactgatttttaaaattgctatctgcagtatataagaaactctttgatttctcatatgctctgagactgctttttgtttcctttggttttatgcttcagctctggacttcagttgccagagtgtgccagatactggggtcgtccttaaagcaactttccctttcttatagtcatcaatttttagttggccacatgtagacattctggaccacataaataaagacaacaccctagagatggtgaagtaagttgtaaactaaaatcctaagccccctaattgactgaatggaacccctcttgaccaaagtgaccccagaaaaaccttaaaactgagttcctggccatgacgggatgggaggtcagacacgcttcattatatctccgtctcttttatggtttagacacagcaactgaccagcattaatgtcaaaataaagatcataaggctgacagaatagaccctttgtggcaataacaaattattcgtaagatctaaggtcatgccaggcaagtgttatgtcatgcactcctacacttaaagaataaactatgttctaactgccaaaaaaatt

SEQ ID NO: 346767 - DNA, 1926 bp, Homo sapiens
cccccagcctgggcgcgtccatcgtcgagtaccttctcctctgcctccccctccctctgcttctatctctctccaattgccctccctggcctgcggccgcccggtcctccttcccagcccagtgcagccaggcacccgggttcggcttgctcaggtctctgtccgggactgggaagccacggagggccgggaaagtggcacactcctggagctcaagcttcctactctctcatcgctgaataactaccgggcaggactgggtggaacagacagcatatttaggtcattgatgggctgctgggtggatggagctggaaagtgatgggcactgctttctggggctgcccaggttccttccgagggctcgcttttcctgggcagagcgggaaagaggaggggcaggccggtcgcgaaacgcaaatagtcgagaatagcgatccggggagaagcaggtgtctgtggggcccaagagaagtaccatctcgtgtgggaacacagcagttgtggaagtgaagacaggactggacccagaataagggttcaaatatgtggggaaatctgacctctaaattcttataagtcagagagtgactgaacaacagcagtgagacatcgaagagttttaatatctgctgtaaaccttggcacagatcatttacttctctaagactgaatccaaaaagcacaatggaatactataataagctgagacagcatggtgaattccagacaagcctgagcattccctatagccagagaaggaggcccaacacctaacatagccttggatgcagaactgatagaacttggggaaagtgatgaagtagttgacctcacctgtgaatctctagcacctgtagtgattgacctaactcaccgtgactctgtagtgattattgaacaaaggaggaggccaagagcaaacacaaggccactccaagaccacactggcagttgtgtggtgaacaatgatgaggagggagtgaaaagggacagagatgtatgtataaccaacagtgcccaccataattccctgcaaaaaaattttttttgtcatatactacctggttatattcagtgtcaagtttgcatggatggatgctcagagattgaacttagtatacaacacatctactctatagaatgtggccacatctgtagtcagtgcttctgcacttcctttacacatactaacactgcccagtttgtttgaaaaaaatcagcctccatcagtatcactgcagttatatatgatgtatgccttattgctcaagacagatcctgtggctggatttttccatgtctttgtgcaggaactatgggttgttggcatccaatgctctgagcttaaaaatactgatttttaaaattgctatctgcagtatataagaaactctttgatttctcatatgctctgagactgctttttgtttcctttggttttatgcttcagctctggacttcagttgccagagtgtgccagatactggggtcgtccttaaagcaactttccctttcttatagtcatcaatttttagttggccacatgtagacattctggaccacataaataaagacaacaccctagagatggtgaagtaagttgtaaactaaaatcctaagccccctaattgactgaatggaacccctcttgaccaaagtgaccccagaaaaaccttaaaactgagttcctggccatgacgggatgggaggtcagacacgcttcattatatctccgtctcttttatggtttagacacagcaactgaccagcattaatgtcaaaataaagatcataaggctgacagaatagaccctttgtggcaataacaaattattcgtaagatctaaggtcatgccaggcaagtgttatgtcatgcactcctacacttaaagaataaactatgttctaactgccaaaaaaatt

SEQ ID NO: 346768 - DNA, 98 bp, Homo sapiens
ggatttgcgttcccaaacagccactaacacaaagtcaaggcaaactgtctgtttctcactgataaaatgagcatcatctttaaggtccttccatcttg

SEQ ID NO: 346769 - DNA, 460 bp, Homo sapiens
ttcccaagagaaatcggtgagtttggtagatttccagttgtactggtgggaaattgagcagaaacactggcactcatgtaatttttgttcttgttctttctattgttgttttctccaagagaaattgttaactttgctatatatcccaccgtattcatgagaaatgtagtgggaaccccactgcattaatgtcccccctttacttgtatcattttgcatatttagtagagctaagatgcttgctgccttcattaggagcttgctgtatgcagtgggaattgcaagcctccaccatctcagtggctcatctcagtaattggttggaaaagtgatttccaacagctcatgctctctggagctatgactttgagcacttcatctcaccacaggcctccttgtcagcctgtgatatgttatggctctcttttgtctgaccgtatgtattctttcattgtctctg

SEQ ID NO: 346770 - DNA, 516 bp, Homo sapiens
atgggctttcctcaaagtgtgacagtggaaccgaatgcatggagtccgaacacggctggaaaatccagacctagacagtcacaatggcttagtgaggaaataccatttaaattgggtattcaaggaaatgatctgacaggcggtgatggagtggggaggtggggatttcagggagaaggaataacaggagcaaatccaaggaggattgaaggacggggcaaggctgttgtgctgattgcctcctggggcgtctgcagatggaaagagtgacagaggagctgctggggagccaggggaagtggcagggcaggaaagcagccctttttctgatatttatgccagcttcagaaagctactgtggggtgaggtcgattcggcacattgcatccctattttcaaagctaacttaagggcaggtgggacaccattcaggagtaaggatcttcaaagcctttctttcctttatgggacttgttagtgtgctctactgggcactgccagcttctcctcaatgtc

SEQ ID NO: 346771 - DNA, 1919 bp, Homo sapiens
ggggagtgcctgtgtggctgagggacacgtccaagctgcagtcggctctgtggttgtggacacctggcagaaccatgccttctctagtctgggtcatccaaacacacgtggggtgcaggggccaggtggagccctcttgtcgtttttgttatctaacggtaattacggagtccagaaagagaattggaaatgccggcagtttaattaaagctgaatggcaggagaggggcatttggaggctccctccctgccttcactccccgtcctgccgcccaggcaggatgtcagatgaggagacgttgagctcatcaaacacccaatgagaagtcttacaacatcagaagctgtctgccaatgcgcctgcgacagcttatagaaactgctgccgcctcgaatcaacctctctccccaggcattgcacgtcagtaggtaaccaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctgattccccacgccactccccacccaagagattggtggaataaaagggaagagggcagggccctga

SEQ ID NO: 346772 - DNA, 2089 bp, Homo sapiens
aggtgaggcgccccgcccctcggcggctccaggtgcggctgtgggacctcggaccgcggcggggccggggccaggccggggccggggccggggcgccatggccgagtcccagctgaactgcctggacgaggcgcacgtgaacgagaaggtgaccgaggcgcaggccgccttctactactgcgagcggcggcgggccgcgctggaggcgctgctgggcggcggcgagcaggcctaccgcgagcggctcaaggaggagcagctgcgggacttcctctccagcccggagcgccaggccctgcgggccgcctggagcccctacgaggacgccgtccccgccgccaacgcccggggcaagagcaaggccaaggccaaggcccccgcgccggcgccggctgagtccggcgagtccctggcctactggcccgaccgttccgacaccgaggtgcctcctctggacctgggctggacggacactggtttctaccgcggcgtgagccgggtcacgctcttcacccacccgcccaaggacgagaaggcgccgcacctcaagcaggtggtcaggcagatgatccaacaggcccagaaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctgattccccacgccactccccacccaagagattggtggaataaaagggaagagggcagggccctgagcctgggatcccaagttccag

SEQ ID NO: 346773 - DNA, 628 bp, Homo sapiens
ggaaagtggacaggagatgagacagagactacctctgccccgtcctgcagctcccccctgcctcttccctgaatgggggctcaggcgaacttcaagatctcaacacctttccttttgttgaaagtcaagcctttaaccttggctttactgttaactactgaatcatatgcccagtttcaattttatccctaggctgctgagactgaaggagggagctctgggctggtcctggggtgcttagcctgcagaatcactgatgtcaaagtgagggctgttgttctcttctggggccttttgagaagaggcaggaaccaccctgggcttgtccatgcctgaagcaagatttggggacttcttcctgctcgccaaagagggttccctatggaaggctgtaggaagcagagcgtctagtgaagacaggagcctgcaggcagggtccatacacaagggggctcttcctctgcagaagcaaggacctggcacggaggctggcccaacccaggtgacagggccttctgctcttcccaacagaacatccgtgtccgctctgtgacaggcgtcggcttctacatgcccatggggaggatcaaggggaccctgtcatcaaggttcctgatggtggacggtg

SEQ ID NO: 346774 - DNA, 2486 bp, Homo sapiens
aggtgaggcgccccgcccctcggcggctccaggtgcggctgtgggacctcggaccgcggcggggccggggccaggccggggccggggccggggcgccatggccgagtcccagctgaactgcctggacgaggcgcacgtgaacgagaaggtgaccgaggcgcaggccgccttctactactgcgagcggcggcgggccgcgctggaggcgctgctgggcggcggcgagcaggcctaccgcgagcggctcaaggaggagcagctgcgggacttcctctccagcccggagcgccaggccctgcgggccgcctggagcccctacgaggacgccgtccccgccgccaacgcccggggcaagagcaaggccaaggccaaggcccccgcgccggcgccggctgagtccggcgagtccctggcctactggcccgaccgttccgacaccgaggtgcctcctctggacctgggctggacggacactggtttctaccgcggcgtgagccgggtcacgctcttcacccacccgcccaaggacgagaaggcgccgcacctcaagcaggtggtcaggcagatgatccaacaggcccagaaggtcattgctgtggtcatggacctcttcactgatggtgatatctttcaagacattgtggatgctgcctgtaagcgccgggtcccagtgtacatcatcctggacgaggcaggagtgaagtatttcctggagatgtgtcaggacctgcagctcactgacttccggattcggaacatccgtgtccgctctgtgacaggcgtcggcttctacatgcccatggggaggatcaaggggaccctgtcatcaaggttcctgatggtggacggtgacaaagtggccactggatcttacaggttcacctggagttcctcccatgtggacagaaacctcctcctgctcctgacaggacagaacgtagagccctttgacacggagttccgggagctgtacgccatctccgaggaggtggacttgtaccggcagctgagcctggcgggcagggttggcctccattactcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctggagagcttcctgaaagacctggttacggtggagcaggtgctgccccccgtggagcccatccccttgggagagctgagccagaaggatggcaggatggtctctcacatgcacagagacctgaagcccaaatcccgagaggcacccagccgaaacggcatgggagaagcggcccggggggaggccgcccccgccaggcgcttcagcagcaggctcttcagtcgccgagccaagaggcctgcggcgcccaatggcatggccagctctgtctccaccgagacctctgaagtggagtttctgacggggaagaggcccaacgagaattccagtgctgacatctcaggtaaaacaagtcccagttctgccaagcctagcaactgtgtgatttcctgagctgcgggatggtggtgggcaggacgtgtggatgcctgcctgccctgccctgtgctgtggagagcgcaggtcgcacactgcaccagtttgcacatcagacgccaactggccttctgccctgcagcctccgtcctggcctcagggacgctggatcccaaatgagagggtccgaagcatctcagtcacacgcctccaccggactgtcggtggctgggcaggggtcagtgccacggcctccttgtttacatgaagtggaagcttgaccagtgtctgctcgcctttgtgccccaccccctccgctgattgccagatggggtgagggcccattctttaaacctttatggggtggggtgtctggggcagctgcagtggcttctcctttcccaggcttcctggtgcttctgattccccacgccactccccacccaagagattggtggaataaaagggaagagggcagggccctgaaaaaaaaaaacaatacaccacaccaccacacagcaacacgacacaaaggaaacaagcacacaccgcatacaccaagacaaaagcaaacaggagcaacagaatccacaacgcgccagacagcagcagagacgcctaccaaacaagccacagacaacaccaaaagaagcgaaacagcagagcgcacaacgacagcagcaccaccacacgacccgcaaacacgcgggagaggcgaaagaggacaccaggcaaggcaagccagacgcacgagacacaacacgccggcgagaacgaagcccagcgacggggccgacacgagacgacacagcgcacaaacggacacaaacaaccacagaggcgcgacaaccacaccagacgaccggagacagagagagacggcagacaaaccaccgcaccgcgg

SEQ ID NO: 346775 - DNA, 514 bp, Homo sapiens
ttatccttttttgtgcctcaaaatagatcctgttcagacatgttacaaattagtacaagtttattttgatataagaaaaaattgaaatccatgtatagtttttccataatatgtattttccatgaactttttgaaattcttcatatttgctgagatgatattgctaaggagttatataatataaaaagttacatgtttgtgtgtttatatatgttgcatatgttatatatattcaaattatcattgtatctgatacaagtaaacatattaatttgaacctaactctattcaagtttgtaactctctaaatactggtaaggatgatttatctttatgttatgtttatatattggttgctaagcaaacgccataaagactttaaaagaacagattacttttaaatgtaaacatccatttatatttgaaaaaagacataagctttaattgacaagctttgtaagcctaattgtgtcattaaaaactcagtagaaataaaggtatcatatgtacttta

SEQ ID NO: 346776 - DNA, 354 bp, Homo sapiens
aaaaaaaaaaaaaaaccggcattattagcactatataaaaagccttacatttatttttattttttcttggagaagagagtatttataaaacagcttgcatattgtcttgataaagtgtttattccttagccttctttcttactttctttgtatagctttgttactttcatatcaaagagtaaattcctcaatgtttggagctaaagaaatagaactcttaataacctgacttagaaatcattacagtgggctgggcacggtggcttacacctgtaatcccagcactttgggaggctgaggcaggtggatcatttgaggtcaggagttggagaccagcttgaccaacatggtgaa

SEQ ID NO: 346777 - DNA, 491 bp, Homo sapiens
cggcattaagaagaaggcagaaagggcaggcttgatagcttatcttaaaaaagctactaatgagtaataattggccactgccttatttattacaaaacaaatgtctcatgactgttttatgtgtaccatactttaatagatctcatacaccagaaatcagatcataaatgacagaatattttgttgggcagttgtgatttaaaactaagactagcttgtggttaaatgttcagtttttgaattttaatagtaattccaattcagaacatggtatcactgtttaccccttctaaaaatatgattagactttgttagtaatgttcaacttctcacaaagatggtgagtgccatcttaaaacttaatagaggccgggcgcagtagctcatgcctgtaatcctagcactttgggaggccgaggcgggtggttcacttgagttcaggagttcgagaccagcctggccaacatggtgaaaccccgtctctactaaaa

SEQ ID NO: 346778 - DNA, 351 bp, Homo sapiens
cctgtcatctacattaggtatttttcctaatgctgtccctcttctagccaccacctccggacaggccccgatgtgtgatgttcccctccccgtgtccatttattctcatggttccactcccacttatgagcgagaacatgtggtgtttggttttctgttattgtgttagtttgcttagaatgatgttttccagcttcatccatgtccctgcaaaggacatgaactatgatgagtaatttttgatagaaacatggtcattggaaggaatttcaagatggccatctttattcagctgcaaagggtcactcccacatacagagactaggatttcagctaaactagcataatttg

SEQ ID NO: 346779 - DNA, 435 bp, Homo sapiens
cttccagtgaatataaagcgggcagaaaaacgtgaaaaaggagacgggcctagcctcccagcttacgtctttctcctgtgctggatgcttcctgctctcgaacatcgcactccaagttcttcagttttgggactcggactggctctccttgctcctcagcttgcagatggcccattgtgggaccttgtgatcatgtaagttaatacttaataaactcttatatatatcttattaattctgtccctctaagagaactctaatacaggcacaatacgattttgaagcatttatttgagtaagaagcaatttggggattgggaaacgccaaattgaaagagatcacatgttgccacgaccagtcttgaaaggcaaatatgtgtaagatatatgcagaagcaaaataaataaattatttgatgggttgcgatgatatta

SEQ ID NO: 346780 - DNA, 1880 bp, Homo sapiens
gatgtgtaaaaaattggagacaatctatttgataggtattttagttttcgattgcagaatatcaaattaccaaaaacttagtgaatcgaaatgacacacatgtattatctcacagtttacctgcatcaggagtccaggctaggttgctgggtgctctgcctagggtctcacaaggcagaaactgaggcgtcatttggggctgaggcttgttggcagaatttgtttttttgcagtggtacgatggaggtttctgggtttttttttctggctattaactgggggctgctttcatccctggaggtcttctactgctccctggcatgggggtcccctctacaacaagcacttgtctttttaaggcaggagaatccctctcccttcaactctccaacgttaagtgcttgcctcattatatcagacctgcccaggaaaatctctcttttcatgaacccaaagtcatctgattagggactttaattgcagctgtaaaatgagtcatgggataatatcccatcatagtcacaagagccactcatgatcaaggagagggattatgcagggtgcatataccaggggtgggaatcttggaggccactcagaattctttctaccaccagggcatgaggcagatacataattatattataatatgagacatcctgacaagcatattttttgagatgaagtctcactctatcgcccaggctggagtgcagtggtgcgatcccggctcactgcagcctccgcctcctgggttcaggcggttctcgtgcctcagcctcctgagtggctgggattacaggcttgcatcaccatgcctggctaatttttgtattttagtggagatgggggtttcaccatgttggccaggctggtctcgagctcctgacctcaggtgatccacccaccttgtgctcccaaagtgctgggattacaggtgtgagccaccacacctggccctgacaagcatcttcaaacaagggaaaactgccttgtgaagccagaaaacagaagtcatttcctgctgtaggggttgggaggcatggcagaggcaatgagtatgatttgagtaggcagaaatagaggcgaggggcagtgaggtagaaacggagtggaagaagcacatcccaagggaggcaaagaaggtatttcgggaaaatggtgaatgcttttggttggctagaacttgctactctgtggtttttaagagacttgtgttttgaacctattgaaatctatagaaaaggtgatggggacactcttgggtatacctgattccatgagcgtcctctgcttttttcatatactggctaatgaagaagaggagaatttggccacatgtctgttgaatgtggtgcgttgaatcctatcaccatagtcacccttcaggaccttgaaaaagtctttcttctccaccatttctgacagagaattccaaacttaggggcttctgtgtcttgtaaaatgcctttctcccttgtagaaaaggtagacaagtctgaaaaaagtgggttcaattctgtaagctacacattaaaccagctggagttggttgtaggtaaaataactcaaaaccatgttgtataagaaatgtgttggctgggcgcggtggctaaggcctgtaatcccagcactttgggaggccaaggtgggcggatcacaaggtcaggagttcaagaccatcctggccaacatggtgaagccccgtctctaataaaaacacaaaaattaattgggtgtggtggcacatggctgtagtcccagctacttgggagactgaggcaggagaatcgcttgaacccgaaaggcggagattgcagtgagccgagattgtgccactgaactccagcctggcaacagagtgagacactctcaaaaaa

SEQ ID NO: 346781 - DNA, 424 bp, Homo sapiens
ggtctcttgttttgtttctctaacgtcaccagtttcattggaacattttggtcatttttcaatggggtgggggagattgatattcaagtaaaggagataaagggggcctaaaatgtaaacttattgagttggccataaaaagagagaagcaaactaataagcttttggaagtgatgctgttctacgtagccaagagtgtgagacatgtttcaggatgtaagaagccagaggaaatgagataagaggattagattggacacttctgtgagtctggaatccctcctaggttggggagtggtggcagttttagcggatagagagaattcacatctctgaaagcagagctgtcttctctaggctctgaatattagaatcaccagggaagctttaaaaaataactagtgaactctggcactcccccaga

SEQ ID NO: 346782 - DNA, 404 bp, Homo sapiens
taggggtgggtcctaagaatctgccctttaaaatctccctaggtggctctattgtgcattcaggattgaggaccactggatagaggctatacaacgtgatccaattcacgtgtcccaggtaacagacctgggtgaagccacgagaccacatccactgtgtctagagcagcattgtccagtagagctgtctgagagggtggaagctgtgtctgtgttgtctaatgtggcagcactcaccacacactgctgttgggcacttaaaatgtggggagtgagactgaggaactgaatttttaatttgatctttattttaagtaatttaaatttaaatagctgcatgtggctagtgactactgtaggcagctctagatccatgtaatttttgtcttattttaccaaaaaaa

SEQ ID NO: 346783 - DNA, 1414 bp, Homo sapiens
tccagccattatttaataagtgcgtcctatgtgtcacttgttattctaaatggtaatatagtaatgaagataaagcccttactttcatgaagagtgcatgtacattctacccttagaactgtaggaacacaggaatgacatttactccagacagtgagttttagagatgtttcatagaggtgctgatatcttaatttagacttaaaggctgaataagaattagccacatttaaaaaaataattttatatcaggaacctcagttattcatagccaacaagcaaataccttgacccagctctgttattaacctttgctcataatttcagcttagctgtacacttctataaggcccaaatcatcagtgaggtcagtagtagtagatcttagtagacttcatatttttttcctgaagcttgtattttcctgatcccatccttccctctacacatatatagagaaatataaatgttagggatatgtatacctaagaggagaaacagaacacttttacaaatctagataatttaatgtctataattaatatatatttataagcagatacatacttaatagtagaaacagtcaatgcatattaaccatatgtaggtctggccttatgtctccatattaaaaattcataaattgttgtactttggcattctgtacttgcttcaatagagtattcatttcttcatttttcaaaactgggttactctttgtcatattttatcttcttgtggcctgggaaaattttgttaaacttgtgtgctaagtgtcagtaaaatacagatatcattaaagtaaatatgcagaatataaatgtaaaagatattttaatgactcaaggaattggcagatttattttttggctgaggttaccagaaatgtgactagctactagggtacttataaataaaactcgatttatttatgtcatggaaagattcttaagtttgtgaaaagaattaccttccatttccttcaaataagaatgtcatattcctgtctatattttagaggtaatcctagaatattagagttggcactaggtctctttaaagcagtgttttaaaactggttgtcacccattattatatcataaaatcaatatagccagtcacgtgcaacattttccttttgttaatgaaatgcaatgtcatagaaaacagcttgtatggttcctagtaagggtaagtatgatttcatggaattcttgtcttaattatattttatatgtttgtgttgtatatgtgtatatatatatatatatatactagattgcaatatcaaatgttatttcttacaagggttacagtcagaagtttgaaaaaaaaaaactgttgccctagacattatcttatccaatccacacatttttataagtgaggaaactctcctacagaaaggtctact

SEQ ID NO: 346784 - DNA, 273 bp, Homo sapiens
gggcaactaagcaagaccctgtctcaaaaaaaaaaaagtgaaatattaatacatacaacagcatgatgaacctcaaaataattatgctggagtggaagaacaaagacaaaaaaagagtatatgccacatgattgcatttatataaatttctagaaaatacaaagtaatcacagtgacagaaagcagttccagtggttacaacttttgaggatgatggatgcattcattatcttgactggtgcgatttacaggtatatacacatgtgaaaactt

SEQ ID NO: 346785 - DNA, 438 bp, Homo sapiens
tgctattaaatgtaaagtcaagtaaatttatgttaaagtaaaatgtagtgttctcattccactaaccataaacatagaagtttagagctgggaaggaccttgcaggccaggccccttattttgtagacgaagtaactaaagcctagaagggttgctgaggtacccagcatcagacagcagcacaagtcagcagcactgaagtggagacaccacaggctttggagacagatccatctgcatttgaccctgatattccaccctttagctgtgtggcattgggaaccctcactctttcaaatttcagtttcctcatgtatgaatgagggatcatatcactatggtttattgagcaggcctgtaaagattaaaagtcttaaacctgaagtgcctagcacagaacttttgggctaaaatgacataataggctgcgcaccatcg

SEQ ID NO: 346786 - DNA, 421 bp, Homo sapiens
tctcgatgttttaagaaagtttatgaatctgtgtttattcaaagctgtcatggcccacatgtggcctgtgggctgcagggtggacaatcttggtttacatgcttttggcattttcctgaaatagttggtaacttgtaattacatggctttgctaattctgtgctcttgtcatatgtcaagaaatttttttcatctaatgaagacattgtttaaatatgttcttggtaataataatctggacattttattttacatatcaaagtactacacatgctcaattataaccagtctgcctcctattttgttctcagttcattttgttatacttcaattgaactatccaatttcctataaacaatatatttaatttccttactactgatggtcactgcctattcagttttcagctgagaaaaaaatc

SEQ ID NO: 346787 - DNA, 679 bp, Homo sapiens
gagtttgaagaagaaaatgagctttgtcaattattctatcacccagtgataactggtcataaccttttaattagtctttagttatatatctttcaagttcttactatgtatgtatatattgttttataaatagctatttttttactggtcaacgtatcataaaagttgtatctattgcaatagactttactaccattttttaaactgcataataatgcactgtatgtactacaatgcaaaccccaccccgtcctagccacagtgatgtatatttaaggcatgtctattaaacagggctgtgacaaacatccttacaaatacatctctgcaaggttgtatgatgatcccctcaggataagtggaatttcagagtcaaatggtatgcacattgacggttttgaagcacgttaccagattgctattcagaaaaatgtattattttatgttcccattaactggggtttgagggtgtgcccatccctgcttgcttaccagctctggatattgccagtcactttaatgctttccagtcctattgggtgaaaagtaatctcatgggatatgcatatctttacttctccttccccttccctttcgcctgccttatgaattgttcatgaacttggtcattttcctgttgaggtattcgtcccttcctgattgattttcaagctctctt

SEQ ID NO: 346788 - DNA, 1084 bp, Homo sapiens
acagctctgttttagcgttgttttctgatttgagactggtggaatttggatatgcagctctctacaaaatctgcagtgaatgttgctgggctggtgaagatgctttattatttttttaatcactcccctgccctcctgtctgctcctctatgtagggatacttagtttattatgggtctttgttcatgttgactattttacaagagtggttcttagttctggctgagaatagaatctgttgcagcacttaaatagaaaggccgaggcactgctggacctgctgaagaagactccctggggaggacacaagaagtcatagttttagaagaaccacaagtgatcacgtgggaaccccacgcttgagaactggatttcaggcttattccacttggagaggaatattagatttgtgttcttaataaatatgatggcagaattgggaaaggaatgatcgggtaccattaagtttggcccctggataataccataacaaaatgactttaccttggaagcatgagtgtctaaaagtacctcaggtgtactcaagggtatgcactaatggtactccatgttttctgttttttttggttgttgttgttgttttttttgttttgttttgttttgtttgctttttgagctcaagtattaatctcattctgaaagaattcgcaaattcaaaacagtgttcaataaatgtagcccacttctctttgccttttatgggatacaaataatgtttatgttgcgtgtgaaaggtataataattctgtttaattctgaagtgattctattaaataggcttgaggaaacataactgggattatgagtggtgttgggataagtgatctgtaatgtccctctaatgctaagattttgtggtttaagaatggtaatattcaatatttagatacctacaaatgaggagattcgtttgtgtggggccagggtaccattatagacacattaatagattgtatacttgcatttgtgggctgtgtgggtgtgtgggtagagagagagtgtactttatatgcttattaatgggtggcaatctaattgtaaaaatagcttttttttttttttc

SEQ ID NO: 346789 - DNA, 1471 bp, Homo sapiens
aaattaatgaacgtattttaccatgttaacagactaaaaaggaaaaaaatatgaacatctcaataaatgcagaaaaagcatttgataaaaattcagcaaattagaaatagagataagaattctcagcaaattagaaaaaagagggcttccttaacctgataaatggagcatatttatgaaaaacctacggtttaacattatacttaatgacgaaagactaaatgcattccctccataaacacagacaagggaagtatatctcttcttaccacttttcttccacattatactggaggttctaatctgtatgatgaagtaaaaaaaaaagaaataaaaggcatccagattggcaaggaagaagtaactttttatttgcagatgacattgattatctacggatagattctacaaaaaagctactagaagtaatatgtgagttgaacaaggtaggatagaagatcaatatgtagacatgaattgtatttttgtatattggcaatgaacatttggaacttgaaataaaaattaatgccatgtataaaaacatcgagcactatgaagtacttagagataaatctaaaaaaagatgtttaagacttgtacactgaaaattataaagtgttcccgagagaaattaagataacctaagcaaatggagagagatactgtgtttatgcagcagaagactaaatactaagatgttaccttcccccaagtgttctgtgtgtactatgcaatcccagtcaaaatcctagcaggaattttttggtactagttgacaagctgattctaaaattcatatagaaatacagaggacctagaacagccaaaacaactttgaaaaagaagaaaaaagttgtaagacttacactacttatcttcaagtcttattataaaactatagtaatcacaatagggtggtatgggtttcaagacagacaagtagattgatggaacagaatagaaagtctggaatagattcattcacatatgtgataaacaaaatgtatatgtatacaatgaaatattataattcaatcataaaaaggaatgaaatactgatacgtgctacaacatggatgaacctttaaaacattaggctaattgaaaaaagccagtcacaaaagatcactatagagtggtctctatagaaatagaagataggttagttggttgcttagggctaggctggaaggactgggggacagggttttttttgggatgatgaatatgttctaaaattgactatggtgatggttacatgtatctttgaatataccaaaaatcattgaattgtacaattttttgtatggtatatgacttatctcactgtaactattaaaaagaaaacacggttgggcatggtagctcacatctgtaatcccagcactttgggatgctgaggctggaggatcgtttgaggccaagagtttgagaacagcctgggcagcaaaggccctttctctacaaa

SEQ ID NO: 346790 - DNA, 3305 bp, Homo sapiens
tatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctggtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactac

SEQ ID NO: 346791 - DNA, 2995 bp, Homo sapiens
tatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctggtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacaggtatgtctgttgtaatatttttaaatgattacttttaaaagattcgtaaaagcattccatagaagtttaatgttaaaaaaatttaagcggcatcatgcctgttagattattttattcagtaaacattttttgcctgccaacatatattagttactgtatgaagctaagggacattattcgaaaaaaagaa

SEQ ID NO: 346792 - DNA, 2406 bp, Homo sapiens
tatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctggtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggtatggatcaaagaaaggaaaaatatctttagatggttaccagaagtttttctttttctttcttgtgtgtgtgttttgtattaaataactaggtcaaagaaaaattaacaaaaaaattttgcagaaaatgtcttcaaacaagaaaacaatacacaaaattatatgggcaattcacagggtgcttaggttttaattttttaaatatgttaatgttttgttaacactatgtaaggaaacttgataattttattaaaaggttgtgggaaaat

SEQ ID NO: 346793 - DNA, 542 bp, Homo sapiens
ataaagtatattaataattctacttaatattagttactgaagtttgcctttccctaaatatgaatatttaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacaggtatgtctgttgtaatatttttaaatgattacttttaaaagattcgtaaaagcattccatagaagtttaatgttaaaaaaatttaagcggcatcatgcctgttagattattttattcagtaaacattttttgcctgccaacatatattagttactgtatgaagctaagggacattattc

SEQ ID NO: 346794 - DNA, 3410 bp, Homo sapiens
tatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctggtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaagaggttcggacatctagcactaatgtttcccatgccctctgcctctgcaaaaagaggagctcatggtccacaggatttggcagattactttggaaaggaaagctgggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaagtgaggcactccagttttatttaagtattcccaatataagttatataactgcattaaatatgtgtcaccagttttcatctgtgaaaaggatggctaacagctcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactac

SEQ ID NO: 346795 - DNA, 3205 bp, Homo sapiens
tatacctaatgataatatttctgatgagccaagtctctgtgactgtgatgtacataaacataatcaaaatgaaaatttagtacctaacaatcgtgttcaaatacacagaagccctgcacagaatttagttggagagaacaatcatgatgttgataacagtgacctcccagtattgtccactgatcaagatgaaagtttgctgttatttgaagatgttaatacagagttcgacgatgtgagtctttcacccttgaacagtaaaagcgaatctttacctgtgtcagacaaaactgctattagtgaaacgcctctggtctctcagttcttaatttctgatgaacttttgttggacaataattctgaactccaagatcaaatcacccgtgatgctaatagttttaaatctcgtgatcagagaggtgtacaggaagaaaaagtgaagaatcatgaggatatttttgattgctctagggatttattttctgttacctttgatttaggattctgtagtccagattctgatgatgaaatattggaacatacatcagatagcaatagacctctagatgatctatatggaaggtatttggaaattaaggagataagtgatgcaaattatgtttcgaatcaagcactaataccaagagatcatagtaaaaattttactagtggaactgttattatcccatcaaatgaagatatgcagaatccaaattatgtacatttgccactgagtgcagcaaaaaatgaagaattgttatctcctggttattctcagttttctttaccagtgcaaaaaaaagttatgagtacaccactctctaaatcaaacacattgaactcattttctaagataagaaaggaaatacttaagacaccagattctggtaaggaaaaagtaaacctacaaagattcaaagaagcattgaattcaacttttgattattcagaattttctctagaaaagtctaaaagcagtggtccaatgtatctgcataaatcctgtcattctgttgaagatggacaattattaacaagtaacgaaagtgaagatgacgagattttccgaagaaaagttaaaagagcaaaaggaaatgttttaaactctcctgaggatcagaaaaatagtgaagttgattctccacttcatgctgtcaaaaagcgcagatttcctataaacagatcagaattatcatctagtgatgagagtgagaattttcccaaaccatgttcacaattagaagacttcaaggtttgtaacgggaatgccagaagaggcatcaaagtcccaaagagacagagtcacttaaagcatgtagctaggaagtttttagatgatgaagcagaactttctgaagaagatgcagaatatgtttcatcagatgaaaatgatgagtcagaaaatgaacaagattcctcattacttgactttttaaatgatgaaactcaactttcacaggctataaatgattctgaaatgagagctatttacatgaaatctttgcgtagtccaatgatgaacaataagtacaaaatgattcataagacacataaaaacataaacattttctcgcagattcctgaacaagatgaaacctatttagaggatagtttttgtgttgatgaagaggagtcttgcaaaggccaatcaagtgaagaagaagtttgtgttgattttaacttaataactgatgattgctttgcaaatagtaaaaagtataaaactcgacgtgcagtaatgctaaaagaaatgatggaacaaaattgtgcacattcaaaaaagaaattatccagaattattttaccagatgattcaagtgaggaggagaacaatgtaaatgataaaagagaatctaatattgcggttaacccaagcactgttaagaagaacaaacaacaggaccattgtttaaattcagtgccttctggatcttctgcgcagtccaaggtgcgttctactccaagagttaatccattagcaaagcagagcaaacagacatcgctgaatttaaaggatacaatttccgaagtctcagacttcaaacctcagaatcataatgaagtccagtctaccacaccacccttcactactgttgattcacagaaagactgtagaaaatttccagttccacagaaggatggtagtgctttggaggattctagcacttcaggggcatcctgttccaagtcaagaccacatttagctgggacacatacttctcttagacttccgcaggaaggaaaaggaacctgtattcttgtaggtggtcatgaaatcacttctggattagaagtaatttcttccctaagagcaattcatgggttgcaagtagaagtttgtcctcttaatggctgtgattacatcgtgagtaatcgcatggtggtggaaaggaggtctcaatctgagatgttaaatagtgtcaataagaacaagttcattgagcagatccagcacctgcagagtatgtttgaaagaatatgtgtgattgtggaaaaggacagagaaaaaacaggagacacatcaaggatgtttaggagaacaaagagctatgacagcctgctgactaccttaattggcgctggaatccgaattcttttcagttcctgccaagaagaaaccgcagatttgctaaaggaactgtctttagtggaacaaagaaagaatgttggtattcatgttccaacagtggtgaatagtaataaaactcacttcaagaaatctccatgtatgcacaagtaactcatcagaaggctgaggagatctatagatatattcactatgtatttgacatacaaatgttaccaaatgatcttaaccaagatagactgaaatctgatatataatcaagctgctcaagatggggttttcaaagacctctcacaatattaaatgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactac

SEQ ID NO: 346796 - DNA, 3766 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgatgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctca

SEQ ID NO: 346797 - DNA, 3957 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgatgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccacccaggccttgggagggaatggtgggaacatcctctagctcccaggttggaagagatactactgtagccaagccacctaggctggagcccttcagaatactgtcgaagggtgttctactcaggagacagctatcacccataacgggagcactgcctcgt

SEQ ID NO: 346798 - DNA, 3811 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggatccagagtggccagcacctgctcagtcctgtgctgtcctgcaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgatgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctca

SEQ ID NO: 346799 - DNA, 2481 bp, Homo sapiens
cacttttaagaccgctccactcatctcagcactctagaatcccctgacagctgatcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346800 - DNA, 2055 bp, Homo sapiens
ggggtactggggtaggctcctgggcttgggggcaggatccagggtcaggatccaggcagtataaaaggccttcatctgcttctcagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346801 - DNA, 1547 bp, Homo sapiens
ccacgcgtcggggaagtggacctcccaggatgtgcgtgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346802 - DNA, 1611 bp, Homo sapiens
  misc_feature (13)..(13): n is a, c, g, or t
  misc_feature (81)..(81): n is a, c, g, or t
  misc_feature (106)..(107): n is a, c, g, or t
  misc_feature (112)..(112): n is a, c, g, or t
cccaaagaaaganccttcccgagagttcccaaagtatttgaccctcccctcccctattccttccccaacatttttggcctnttgtccccaggatgttcttgttganncaganccaccaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346803 - DNA, 632 bp, Homo sapiens
tgtgcttctgcacaaggcccagttcccttctgatgaggaatatggattctggtcctcagacgagaaggagcagttccgaatttacaggtgatggtagcaggccaactcctctaaaatggagtccagaaataatgaaggcaatgagggaaggggcccaagtccaggctttctgaattttggtgctcctttctgttttctaggtattgttgcagagttgtgggggtactggggtaggctcctgggcttgggggcaggatccagggtcaggatccaggcagtataaaaggccttcatctgcttctcagggtggacatctcagacacgctcatgtatgtctatgagatgttgggggccgagctgctcagcaacctctatgacaagctgggtcgtttgctcaccagctcagaggagccctactcctggcaggtacctcccaagcctgattccctcagccttcccagacctgtcacaccctcctcctcatccaagccagtggcaccctctttccccagcacacagaggccctcctctacggcttccaatccatcgcagagaccattgacgtcaactattctgatgtggtgcctgggctcattggcctcatcccacggatcagcatcagcaacgtgcag

SEQ ID NO: 346804 - DNA, 4043 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgatgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346805 - DNA, 569 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagaagctcctcactgacggctccctcctcggagtccccttcattgggtctcctaagagcaccaattttggtctctggcaagcctcccacccccaaacgaggtggggaggcctcggcagccatgcccgccctgggcccccccccatccccattaaattaatcccaacatgcaaaaaaaaa

SEQ ID NO: 346806 - DNA, 4050 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgatgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagataccaatccctccaacaagcgggggtgggaggagaatcctggggtgagtggaaggggggatggtgggggggtgggggggttgggggggtgggagggtggtggagtgtgtggatgggggttggggggggggggttatgtggcgagatggtgtggggggtggggttgtggggagggggcattcagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346807 - DNA, 3404 bp, Homo sapiens
ttccgcgcagttccgctgggccgtgccggcctgtaccgggccgtgccgagccagaactggcaggagtgggggcctgagttggaggtgccggggacaggcgctcggggcagcccgcgccttgccgaggtccctgccccgtcccggccggcctggcttgtcttgtcagtcactggggcggaggcagcggctgtagcggggctgtagccgggcgttgagcacagcgcgggccaggccgaacggaagggacctgccacagcccctcaactccacggactcttcgccctagactagcggagctgcatctccgcgcttcgttggacgcctccgtaaccacgaagggctctctctctcccgtgaccctccagccccatgacctgttcatagcagccgagagctcacccaggcgggggtgttgtgggtacaggccatcgaccctgtgacccctcaagagccagggactcggtttcccccgcaggcctccctcccctgtgactccctccacacagattctggggacagagctgttacctgccactaggatccccgcctgagagctcctcactgacggctccctcctcggagtccccttcattgggtctcctaagagcaccaattttggtctctggcaagcctcccacccccaaacgaggtggggaggcctcggcagccatgcccgccctgggccccccctcaccccaccactccctgggcacccaagccggggtctagcagggggccagcagccaaggggctggggcaggagacagatcagggcccacctccctgccagggagggagcaaagatggagcggcgggaggagcagccgggggctgcaggggctggagcagcaccagccttggacttcactgtggagaacgtggagaaggcgctgcaccagctctactatgatcccaacattgagaataagaacctggctcagaagtggctgatgcaggcccaggtctccccacaggcctggcacttcagctggcagctactgcagcccgacaaggtaccagagatccagtactttggggccagtgctcttcacatcaagatctctcgctactggagtgacatccccactgaccagtatgaaagcctaaaggcacagctcttcacccagatcacccgctttgccagtggctccaagattgtactgactcggctgtgcgtggcactggcctcactggctctcagcatgatgcctgatgcttggccatgtgctgtggcagatatggtacgactcttccaggctgaggactcaccagtggatgggcagggccgctgcctagccctgttagagctgctgacagtgctgcctgaggagttccagaccagtcgcctaccccagtaccgcaaaggcctggtgcggaccagcctggcggtggaatgtggggctgtcttcccgctgctggagcagctgctacagcagcccagctcacccagctgtgtgcgtcagaaggtgctcaagtgtttctccagctgggtgcagctggaggtgccgctgcaggactgtgaggcgctcattcaggctgcctttgctgctctgcaggactcggagctcttcgacagcagtgtggaggccattgtgaatgccatctcacagcctgatgcccagaggtacgtgaacacactcctgaaactcatcccgctggtgctgggtctgcaggaacaactgcggcaggcagtgcagaatggggacatggagacctcccatggcatctgtcgcatcgctgtggccctgggcgagaaccactcccgggccttgctggaccaagtagagcactggcagagtttcctggcactcgtcaacatgattatgttctgcacaggcatccctggccactatcctgtcaatgagaccaccagctccctaaccctcaccttctggtacacactgcaggatgatattctatcctttgaggcagagaagcaggctgtataccagcaggtgtaccggccagtctacttccagctggtggatgtgcttctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatgacaagctgggtcgtttgctcaccagctcagaggagccctactcctggcagcacacagaggccctcctctacggcttccaatccatcgcagagaccattgacgtcaactattctgatgtggtgcctgggctcattggcctcatcccacggatcagcatcagcaacgtgcagctggcagacactgtcatgttcaccattggagctctgtctgaatggctggctgaccaccccgtcatgatcaacagtgttctgcccttggtactgcatgccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaaggccaggatcatcctgatatgtagattccttatgcaattctggcaaagctctgaagcggagccaaatgtcccgtgtgaagatggttgtaagtgggtctccggttggaggggcctccagtcccgggcacaacgctaggccctggagtttgcatggggaccgcccgaccaggaaggctgcatctgcccgcaaaggtagctagtgaaaaagaaaacactccagcgacaaaaagtaaattagactagtagaggagccgacaa

SEQ ID NO: 346808 - DNA, 1692 bp, Homo sapiens
agggtaaaacgactaccgatggagcccaagttttgcacagggctgcccctggagctaaaaaccctaggcaatcctgagctgtctgtctcttctgtgtccaccctcaagaagatctgccgagagtgcaagtatgacctgcctccctatgctgccaacattgtggctgtgtcccaggatgtgctgatgaaacagatccacaagacaagccagtgcatgtggctgatgcaggcgctgggcttcctgctgtcagctcttcaagtggaggagatccttaagaacctgcactcgcttatctcaccctatatccagcaactggagaagctggcagaggagatacccaatccctccaacaagctggccattgttcacatcttggggcttctctccaacctcttcaccacactggacatcagtcatcatgaggatgatcatgaaggccctgagcttcggaagctgccagtgccacagggacccaaccccgtggtggtggtgctgcagcaggtcttccagcttatccagaaggtgctgagcaaatggttgaatgatgcccaggttgtggaggcggtgtgcgctatctttgagaagtctgttaagacgctgctggatgactttgcccccatggtgccacagctgtgtgagatgctgggtcggatgtacagcaccatcccccaggcctctgctcttgacctcactcgacagctggtccacatctttgctcatgagcctgcccactttcccccaattgaggccctcttcctgctcgtcacctccgtcacactcactctcttccagcaagggcccagggatcatcctgatattgttgattcatttatgcaactcctggcacaggctctgaagcggaagccagatttgttcctgtgtgaacgattggatgtcaaagctgtgttccagtgtgctgtgctggccctcaagttccctgaggcacctactgtcaaggcctcctgtggcttctttacagagctgctgcctcggtgtggggaagtagagtctgtgggaaaggtggtacaggaagacggtcgtatgctgctcatagcagtgctggaggccattgggggccaggcctcccgcagcctcatggactgctttgccgatatcctgttcgccctgaacaagcactgcttcagcctcctgagcatgtggatcaaggaggccctgcagccacctggtttcccctctgcccgcctcagccctgaacagaaggataccttcagccagcagatccttcgcgagcgagtgaacaagaggcgggtgaaggagatggtgaaggagttcacactgctgtgccggggtctccatggcacagattacacagctgactactgaggggtgcccccatcccatccaccccttctcttcatccttccctattcccaaagagtaaacctggaccctcactgctgtctctgcctcctttctgctgtcaccaccacctaactgaaagcctgggtccagaaggcctgggggaaggatgggaggatgcttggacccaggccttgggagggaatggtgggaacatcctctagctcccaggttggaagagatactactgtagccaagccacctaggctggagcccttcagaatactgtcattgtccttggggcggggtggttgcagtagtgtcatcaacccccccatccccattaaattaatcccaacatgcaaaaaaaaa

SEQ ID NO: 346809 - DNA, 798 bp, Homo sapiens
gggctgcaggggctggagcagcaccagccttggacttcactgtggagaacgtggagaaggtatgagggctctggggtgggcactccagtgacagagcagaagttctggggactgtcactgatggcagagctcaggcctgggctgggtgcccgctggtatggtgcccccagagcacctggcatttgctctctttctgggcaggcagtattgcagtgccctaatgggctatttttgtctttccttacaggcaggtcccctgtggatagatactctagggtcttgggatggtcccttcagggtgctgtgacttagccttccgtccagactggctatgttccagctccatgggaactgcatgagcagtgcagtaggaaactgggaacccaggagacctgcagctcagtctcctggaattatactgatgccaaaccatcctggacctggttttgttgagccaagggctcagaaaataatctggaactaaaacaatctgggttgttttgactctttggagaagggtccttcctttattggatggaagccagaccagtcctgagcaggcaggcctggggctgtctccctttgttttgtgctgagtccaagggtcctggccctgctgggagccttacagggctcctccctactcgcctgcccacatagctccctgccatggccctcccaggctccccgactgcccagcccatctttctgaactgcctctttggttcttttctgtatctgctccctacaacttgaaatgcaggaatgcatgcaccctgggatgaatggggagatggg

SEQ ID NO: 346810 - DNA, 292 bp, Homo sapiens
tgacctgtagatctgtcagtttagcctgcagacaagaactactcctgtcctcttcactagagaaatcagaagtaatcctgaatttgttgttttgcaggtggtgttcaagaatatctctgtatgtatcttacatcaagccatctatccacaataatattagcctctttttcaaaagggggctcttcaaaagttttcattttatttagataaaattgtagatttttgcagacctggtttatcttgtctacaacttctaaatgctcattaaattcttctttgacaatttcaatct

SEQ ID NO: 346811 - DNA, 923 bp, Homo sapiens
gccttaggaaggagaggagtcagtatgggatggataagagtgaggcagaaggcagagagcctaggtctgtggttagaacaacaggtaaggctggaaagatttagctgagcaggagcatgatggagggtgggaagtcagaatcaaagaaaagggacaactgagtcagcttaggatgttcaagaagttttggtccagaatcagtcttcacctaaaaacgtttcctaagttgaagcatgagaagtagtagcccaggctgttttccattgttaaaaatggctatactgttatgcacaaaggaagtttcctttcctttcctttttcttgtaaagggttccttttaccattggcagttgcactctttggacttcctctttgttgaagttagtgatcagagaacaagatagaccctgctaaccacatttgtccgtgtgttctgcgggggttgggggggtgggggaacaattttgaagttttcatgtccatctcacacattactttggatttgaagcagtataatatttgcaatcagcttgtatgcactaagaccattgtcctctacagtgggggaaggttaagtgcagagctaaacaacacaggtggtggcttgagtaatggtagatgggtgtctggttgaagaggggtgtgagagaggaagaagataaagaatgtagtaatactgctttgtgaggaaattaaacgtttaaaaatgtgatcctcatgtctttaaattaatagatattctttttgtgtcttcacattctgaaacatttgtaaatacatagaccattgttcaagattaaatttagtctgatttaattaaatcatacttaaatgaaaatatgcccatctatttgacttcatattttggaaagaaacagcatggaatgttgacaaatatttatattgcacctataataaattat

SEQ ID NO: 346812 - DNA, 325 bp, Homo sapiens
tactgcaactccctgccaggcctcctcccttccagggccgtcggggactcactcacaggcttgcactgcagcagcctggtccctccctgagggcaaggccacagcccacaagtcccctgggtcctgtctggcacaaaactcagtaaccagaggtggcgcggcttgaacagacacctcactaccaaagtcatcaggacacttgttctttttgactcctacaaagaaattacccaaaagagatgctcccacagaaacaaaacactgcagaccatgaggcttgctggggctggtgcgatagctgccagagcgactcccagggagtcac

SEQ ID NO: 346813 - DNA, 632 bp, Homo sapiens
gatactgaggcgggtggattacctgaggccaggagttcgagatcagcctggccaacatgatgaaaacccatctctgctaaaaatacaaaaaattggctgggcttggtagcatgtgcccagctacttgggaggctgagacaggagaatcgcttgaacctgggaggcagaggttgcggttagccaagattgtgccactgcactccatgggtgacacagagagactctgtctcaaaaaaaaaaaaaaaaaagtaaatgctatgttatgtgaatttcacctcaactgaaaaaaacagggtcccagagctggtcaggggaacttggacaaaccacacaacttctgagcttccatttcctcacaatctctgcagtcacttccaactctcatttggcttattctgtgaaggataaaacagagctgacatttgttcatttgtattgattttatttacatttttcgcccaatcctgtggccccaagaagtattaactgtgcacccactacatgccaggaactgtacttggagccttctcaagagcttcttaacaatattttcattttttatattttttaatgacagggtctaactccgtcgtccaggctggagtgcagtggtgcgatcatagctcactgca

SEQ ID NO: 346814 - DNA, 686 bp, Homo sapiens
gatactgaggcgggtggattacctgaggccaggagttcgagatcagcctggccaacatgatgaaaacccatctctgctaaaaatacaaaaaattggctgggcttggtagcatgtgcccagctacttgggaggctgagacaggagaatcgcttgaacctgggaggcagaggttgcggttagccaagattgtgccactgcactccatgggtgacacagagagactctgtctcaaaaaaaaaaaaaaaaaagtaaatgctatgttatgtgaatttcacctcaactgaaaaaaacagggtcccagagctggtcaggggaacttggacaaaccacacaacttctgagcttccatttcctcacaatctctgcagtcacttccaactctcatttggcttattctgtgaaggataaaacagagctgacatttgttcatttgtattgattttatttacatttttcaaaaggaaatagatgcagatggtatagaaagtttcagtgaaatgtaaatctgatgcccaatcctgtggccccaagaagtattaactgtgcacccactacatgccaggaactgtacttggagccttctcaagagcttcttaacaatattttcattttttatattttttaatgacagggtctaactccgtcgtccaggctggagtgcagtggtgcgatcatagctcactgca

SEQ ID NO: 346815 - DNA, 322 bp, Homo sapiens
tacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaatgaaccctcacattaacatcaactgaccacaagggtgccaagacaattcaacaggtaaagggcagtcttcaaaaaacagtg

SEQ ID NO: 346816 - DNA, 262 bp, Homo sapiens
tataggctctgtgatagatcaatagtatatgaacgaagtggcactgtgctaatttctaagctcaagtcttaagaagttagcagcttctatctctcttggggtacttcatcttggaatgcaaataccaggccatggagaagcccaaactctcccttggaaaggcagtgatggccaccaccaatttgccagccatatgattgagccatgttggaactgggtagtcagtctcttcaaagctgccccagtttatatcacattctgc

SEQ ID NO: 346817 - DNA, 887 bp, Homo sapiens
  misc_feature (479)..(479): n is a, c, g, or t
  misc_feature (489)..(489): n is a, c, g, or t
  misc_feature (508)..(508): n is a, c, g, or t
acggaagaaactttccaaccaacccacagaatcatgaactaaattaggaggtggttgtttgaagccactaaattctggggtagtatgttatgcagcagaagctaactgatacagaagtgatcactgggcatacccattctaactctgctctaaaagcaaaggaaggctttcctttgagttgtgaccataacacgctgtgggccctacattggaccaaacgttcatcctgtttgctcagagatagcctggtatatgcataaactactccttttccaagtttctgggaattgggttgaggttgctgcatctttggaagttggtctccaccactggcaggctgcctgcatcacaagatctcattactcaggagctgtccaagtgtctaatgtacttagttaagaaaaagaggctgggatgacaggcatgagccaccacacccggcccagagatgtttttagttgccattgatacatattgtntttgtcatangaaaagaacttctccttgnccattgaggctataaactatagagaaagtgataccccgggatgaaaatgggaaatgctgtatcatcatctaaactgaagtacattcgtcttccttaaatgtgaaatatatgctgaccttgaatgaagtatagtcatcagactcgcgtcatcgccattgaggcttatagacactgaggaatggaaaagtcgacggcgtcataaaactatcaggaaccggctgttgttgccaccataagttgcctgccctcaggaattagggaggccacaagtaactaacttaatgaaacgccatgattccaaattgatgggagggaggcaccggccttaacttccacctctgttaagacatccgtaggctttattgcgaactgtccctgc

SEQ ID NO: 346818 - DNA, 1872 bp, Homo sapiens
ctcccaaagtgttgggatcacaggggtgagccactgtgttcagccagaaaataatttagagaagccagaactggcttcctttggtgaaaattctttgagcagattccagactggaccttctgactgttataaataaatggtggattcccattatttgtttgtgggacagaaatattgaaggcctgtagaaccataatgccttccccttccttctgtcactcacccacttcatttctcctattaggccccttagaaagagatccctgatgccaggcacagtggcttacgcctgtaatcctagcagtttgggaggctgaggcgggtggatcacctgaggtcaggagttaaagaccagcctggccaatgcagtgaaaccccatctttactaaaaatacaaaaaaattagccaggcatggtggcgagtgcctgtaatctcagctactcaggaggctgaggcaggagaatggcgtgaacccgggaggcggagcttgcagtgagcggagatcaggccgctgcactccagcctgggcgacagagcgagactccgtctcaaaaaaaaagataaagaaagagatccctgactgcctgtatagtttgagaaccactgatcctggggcaaggactcaaagtctctggctctagaagtggctggtgtggacctcaaatggaccctgttctaagagtccaaaggacacatttcaggaagctgtgctctaagcctaaatgaccaaccttgccttcactttggacatataccatctgatcatcttcctcgatttctgttctttgctcaggccttccaatttcttcgtgggtgacccctccttaccagtgctttgctctgagtcagctcaccagacccagcaggctgccactaaaggtttattgtaaaaccttgattaattcagataaccttgaaatacttacataacatcactgacaaataggaaagggagtgcatttccattgatagagactatggctagagttactaaggtctggaaaaaaggcaggagagtgaagtatctggagacgtagggagagaaagagactggtgttaagagaaaaatcacgcctttttcctgcttgtatcttacagtggttctgccaccagtaatgcaggatcccactgatctctctgaacacattttaggacaggtccatattcgggagctgactttgtaacttcttactgtatatagtttaggttcgaatgggatcaccataggtgtgcttatgaccttaactgtaacagcgatgaaataaaaaaaatggtttagtttaataataatgttgtaagagtgtaagtaccagtagcttcatgtacattctacaaccctataataattatgctgaccgtgtaaacagctccctcgtgtagactgagactccattgccaaacatcaagcattaacagcaagtgctagaaaaatcaataagcctttacccagggaaccaaagatatgtgggttactaaaacccctaacagttgcccataaagagtaatatctcattattttaatgccaaaggaggtttttgtttcatttcctaaataataacaagatcgcatattaaaggacgagttgatggagtgataaacattcctggcagcacagacaaatcaacaagagactaaaataaaaagaaatgaaacttgcctcttggcaatctgtttagttgaatttcatagactgagtctggttcaccctggattttcttttcacacacccacacgtcccatttcatgatgacacttgtgcatctattcttcctttgatggtaattaactcttattaacattcatgaagactaagtgtgagcctctagcacagatgacatattcagacaaccacaaaaagatagggtttata

SEQ ID NO: 346819 - DNA, 1240 bp, Homo sapiens
ggagaatcacttgaacccaggtggcagagtccagtgagctgagatcacactactgcactccagcctggcgacagagtgagactctgtcaaaaaaataaagccaaattcatacagtccctgaggagtgggaactgatgcacatctcttgcatacaataagctatgcttgtgctctgaacagtgtaagattgagaattgtattcctttaaagaaagttcggcagaactgtaactgaattactaacaaggcactgagaaggcataccgtactttgtatggtatttggcgaatggcataacacatcaaaaaattggttgtatcatatgattaaattgcaacgtgatgatttcaacttggtggaagacttctgcttcgtcttggtatgtgaaaatcccctttgcttcaaacttaatacacaccaaggaaaacctgatacaagtttgcaagtgtctttgagctaatggcttttcgtgggtattaaaaagcattgggttatttatgtataattacgtagaaagaaaatgtttgttccattcaagatacggttacacaaaaagtcatctagttgtgaccttcaaattattacttatatacctacagaaaattcctataaataggctgggcacttagggaggccagggtgggcagatcacctgaggtcaggagtccaagaccagcctggccaatatggtgaaaacttgtctctacgaaaaatacaaaaattagccaggcatgttggcccatgcctgtagtcccagctactcagcaggctgaggtaggagaatcgcttgaactcgggaggggaggctgcagtgagccaagatcacacaccactgcactccagcctgggcaacaaagtgagacccccatctcaaataaggaaagaaaattcctatgaagaaacactatacctctgagtttcaataatagagatgattaacccagtttccctgcaaggatgtgctcactgtgaacagatgtagtggttaccactccagatgtctgcctagcatttgagacaacagtctctgtcacccctgcctctctctgggaacttctgccccaccaccatacagaggggcagtaggcccagccataatcaactgaaacagacacagagttatgacctgagcctaggcaattaggttttctcaggaatatggatctgggactaaagaactcagcatcttcctgtgactggagttgtagcatgtaagtacagaagctttggagtgcccagaa

SEQ ID NO: 346820 - DNA, 337 bp, Homo sapiens
ataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagacgccaaggagcaacacacgcaccagggtaggctggagaaaccagaacccgggaatcccgcctccctcaacttgaaacttgggaatagtgtattctcttttcaacacttgcactagtagaaggttaattacatgaaagattaggcaaaatgtatg

SEQ ID NO: 346821 - DNA, 287 bp, Homo sapiens
attcgaagttcgagctcggtaccggcatgtgctgtaggccagcgtgaaaaggagatgcagagatgttacagagacatacaatgctcaaagatggcaatttccaaagaaagagaggtgaaggcagctcaggcagtggaatcatcaacctctaaaaagcacaatgtactgaatgtcctgaagctattggggaaaaaaaaaagatgaaaagggcaatgcagttaagtgggaaacacctgggctgggagatgcctgtgcttcttcctagctccgctggcctacagcacatg

SEQ ID NO: 346822 - DNA, 590 bp, Homo sapiens
aacatttaaggaagtttctgttttaaaccagccttggagggttttcatgacaaggaattgcacattggatgatcatttctaccttttgcaataactacttcttatttgcaagttgtgtttaagtgaacaaaggcaaggaccagatttgcctgtcttctttcaagcagatgactgagtcaatcccacattacatatgaggaaactgagacctattcaagttttgccaagtcaggatccagttcagaatcaccactgcacttatttctcacgtctctttcatcttcagtctggaacagttcttcagtctttccttaactttcatgactttacacttctattacaggccaattattttgtagaattttccttaatttgaatttgttgctttaggattagattccaattatgtattattggcaggagcatcatagaagtgatgctgtgttcttcttgctagactatcaggaggcacacgattgcaatttgtcctattactgatgatgttcattttggttacttgattaaggtggcgcctgccagatttttccactgtgaagtgacttccttttgtaactaatgaataatttgtg

SEQ ID NO: 346823 - DNA, 972 bp, Homo sapiens
atgttgaagatgacatgaagatgcagtttacagtcactgggtgcaaacaggagttaaaactgcaaagtataataaaaagcagaataaaaatgctacaataggatgcaatgacagtagactttctaaaagaaataaccatcttgtggtggcatgttagagggtaatttgagtgaggaagcctagcattaaaagagactgactaagaaactattggaataggccatgtgagatcagttcaagggcctgaaacctgcggaagagccacggaaatgaaggggaagagtgagtgagagagatgggagaggaaaatgactgtgcttggtgaccaactaggggcaacagcaaagaagtcagaggtcacacgaagctttctagtctctgcagctgtgttactatatatcaatgatcgtgacaaggaagaccaagatggaatatatgaggcaactgaaaatttgaatctagcactcagcaaatgaccattttaagaatacagcaggaccgggtgtggtggctcacacctgtaatcccagcactttgggaggccaaggcaggaggatcacctgaggttaggagttcgagaccagcctggccaacatggtgaaaccctgtctatactaaaaaatacaaaaaattagctgggtgtggtggcacgtgcctgtagtcccagctacttgcaaagctgaggcaggagaatctcttgaactgggaggtggaggttgcagtgatccaaaatcatgccattgcactccatcctgggtgacagagcaagactccataaaaaaaataaaaaaagaatacagcaggaccttttagaatgagtatttgcatgtttccaagaataactacagataagctctgtaaggaacaatgttgcaagctccggcttggacaaagtttgggtgggcttcagtgggagaggacagaaaaatggtattttttgtcactcctccatccacactctacttttctctc

SEQ ID NO: 346824 - DNA, 351 bp, Homo sapiens
tgtctgtttaaatcttttgaccacattttaatagggcaacttttctttttattattgaattatagtcctttatctattctgaatacaattccttcatcagatatgcgttctgtgaatattttttcccaggctgcagcctgcctattcatttttctactggtgtattttgtgaagttttaaaactcaatgcagtacaatttatcattttaatgggtatgtatttctgtttcctatgtaagaaatctttgcctgcccctcaaatagtgaagatagcttattttcttctagaagattgatagttttatgttttacttttaaatttataattcattttgtgtgtgtgtgtatgta

SEQ ID NO: 346825 - DNA, 403 bp, Homo sapiens
atgtatcccggaacttaaattataattaaaaaaaagagaatcaattttgtatagctacacctagcaacagtattacctagaaatagtaacattttgatgtatatccttccaaaatcatttaaatccacacacacataaacacatatgactacatacaacttatatttatcttattgatataattgactgttttcatttgtttttaaataaatgcccttgggctaggactgacttttactttttgaaacattaattcagtgttgcaagtatttactttgacatttttgcctatgaaatgtcatgtcaaatgattatgctatgacataggaacagagaatgaagaatcatagaataatagaatttaagatctaaaagagacctttgagaatattaaaatctcctt

SEQ ID NO: 346826 - DNA, 2327 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattc

SEQ ID NO: 346827 - DNA, 5017 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaattctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346828 - DNA, 5188 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346829 - DNA, 5020 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttgataaactctcatatatgtgttctgttgaaagtagacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346830 - DNA, 4982 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggaagagaccagctgtgtattttatagctaatatagaatactggaaggttgtaactttattggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactatgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346831 - DNA, 4934 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcattgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346832 - DNA, 3634 bp, Homo sapiens
atgtatctgcgtcgactgaacattgaagatctttttctaggtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346833 - DNA, 3501 bp, Homo sapiens
gcactgtttaaattatgtaacactttaattcacagtgatagtaactgagccattttatctgtgttaatattacattacactctttattttgtgtagtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346834 - DNA, 3574 bp, Homo sapiens
tttaaagcttatccaaagcaaaaagtccatcaggttttttttttttaaatctcctaatttattctctcattaaattacatatggaaatgctgagtctcttcattcaggtcctttgtaaattatggagtttaacttcttaccacatcaggaaattgagaatattactcattgaaggttttaactactgtctgtgttaactttaaggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346835 - DNA, 3258 bp, Homo sapiens
  misc_feature (22)..(22): n is a, c, g, or t
agggggggaaaaggggcctttncaccccccaaatgggacctaatggggtcccaatgcagtgaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346836 - DNA, 5001 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacata

SEQ ID NO: 346837 - DNA, 3280 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaaggtaaaactagttcatttttctttgcttggaaactatgagagaagaacaaaggaaaattttataaaataaggcatactgaattcccagattttagttgtatttccaagttccccagtaccttgttaaagtaaggagatttttttgttttctctacaggaaaacactggccatttgaacatttgattatctcctaattcagaattgtagtaattcaataaactgttactctaacaaaagtttcaat

SEQ ID NO: 346838 - DNA, 2502 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaaagtatgtgtaaccatgtgatggttaaaacaagacttacaattcctaaatgtgtaactgagaataaaacgtactctgttaagagcatgcgatttaaaaacttgttagctaaactaatatgaaagtcttgatgtgagaaatttgagctactttttaatttatataaagttaaattggctttatacttattggtggaagagagtcataaggaaaatattactagtgtatatacttctgtaggtttttgcacatatatttttatattcttcactatcaactgacagagtaggtattattcacatttga

SEQ ID NO: 346839 - DNA, 2411 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttttttaaaccccgcaacccctttgtgaaatggttaaggataatggggcggtgttttaggctcaggaaagagctatgggcatgactgggac

SEQ ID NO: 346840 - DNA, 2403 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtgagcacagatttttaaaaaatagttatttatcctataagatacattaaaaacagtttgattgtagttatattgtatttttatgaagttgctttttaaaaactcaagtggatatgatagggaaggcttgaaactatttcaggggcaaaaaccatagacatttcttactgatttattgcttagagactactgctggttgagaatcctttccatttaataacacagattccactgtagtttgactctcctcaactcataatccaagcatactgagaggcctgattcattacaaaaaaaaaaagttataaaaagacccaggatagctatttttacttaagactattcctgtagattttttgtccccacttgtctataactttcctctgcaatacattttattcattcttattataatatttatagtctagacttcagtttaatctttttaatgaaaaaaaaatgcccccatgattgtatttttaaagattttactgtttcagtacttctaatttttcaagagttaacgcagtctttttcgaaaacacctttcacatgggtatatctatctatctccctatatatctgtatatataaataatacaagatttgtgttgaccctgagtttctcatattagtttagtatcctaagttggagacatgaataacagttatttgaaaagtcagttggtaaatgatggttttttttgctctttatgcaaaaaatgaaatacatgatcagttgagtgaatatgacatgtttccttattccatattgtgtcttccagaataatcaaagatgttggcattcagaagacttttatcaaacttattaacctattttccttcagttgccatattttctactgaatcattttttcattttgatcaggttttgctttttctttttaataggtggaaagaatgggaacataattcaattgttttcctaataagcttcatttcattatggcatttatcatgaaatagtgtcagtagtagtcactggaatg

SEQ ID NO: 346841 - DNA, 840 bp, Homo sapiens
cttgggtagtacctatcaaaataaatgtgcatgttatccagcaatcccatatctagaaatttatctgactgaaatattctgacttgtgtgcaaagacacacacaggtacacaaacatataatggtagggaattggttggctcgactggtacatttgtaactcttcagccctagagtaaaagtaagggaaatctatctgtatgacatgatatggcaagatgcccctagcatgttacgtacaaaaaggcagattgtatgtgtcctggatgtgtcacaagaagatgtgtatacttatccatttaagaactaattttaggtatacagaaaaagtctggaagattatacctcagttatttatgtttgccatgggagaggaaatttttactttctgtgcatttatatttaggatttttgtcatcaggagttatcactttttgactgaataaaagtttttaaaatatgctcacattaaagtttttcaaattttacaatgaaaatgacaatgacaaatcagtagaaaaagaaatgcatgtatcaaatgatgatgtgaactatcaacacaattaaatttgttattgcttttctgagtattatttctttaattgagaagattcaaattttggatgaaatcatggagggagttaatttaaagattacctttgcttttgtcttgagtcctagatgtcctcctaacctaattctgaaatagatcattgtattcagcttgttaatagatttttttttttttctgaactgctgtttttccaactttgttttaaggaataaacatcatcctgaccttcatctctgggcttgttccgggaagcgaaaagaccaagat

SEQ ID NO: 346842 - DNA, 290 bp, Homo sapiens
ccaagagggactagaactctgtggggtgggatgacaggacgctaacctctcggaaatgtcttgagtatgttggccttctaaagatggggaagtgaacccttaactccatcacagctccaactttctgattgtttcattttctgactgttcttccagttgcagtttaaatttgtttatcttcttctctcttttagttctggaaagctggcttgatttcacaggggagttggagccaccagatcctcttgcaagattgccccaacttaaacgccacataaaacagctcctaa

SEQ ID NO: 346843 - DNA, 261 bp, Homo sapiens
cttttcatggatgagaagcgaaagtggtagcatgattatttggtgtatcctgaaacatgactttcgttatttttatagtgaccttaattatctgacactttattaatatttctttctgtatcttatgttgcagactattcagactatgaagacagttccctcgaatttttggaaaggtgctcttctccactaactcgatcttctgggagttctctggcttcacgaagcatgtttacggagaaaactacaacctatcagtac

SEQ ID NO: 346844 - DNA, 2766 bp, Homo sapiens
  misc_feature (263)..(263): n is a, c, g, or t
gctattttagattttattcctgtgaaaatatatccatggaatacctgttattgaatatgcttcctattttatgagaggttatgcaatctaactcatttgattattaaatttgataacctaccatgttcagctatcatgtaaatattgttatctctatatttatgtttatgtagttacctgtgaaagtagctttgaaaatgtgacacatatttttattagtgtaattacattttaattaatttttaatacttcacatgttttgngtttttcctttggaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaagggtctgtctttaaaccacctaatagaggaatttaaaagtgaaggttgcagttgctagattttgccttggctaccttcagattcccacaatacttgtacataatgaactgtgcatgcttttacattctctaagggcttaacttcttaggcactgtaagactataagaacgcagtaatagccataactggatttccttggttctcctgttttaaaatctgagccttaatgtagttttaatatatcctttttgtattacttttctttattagtagcctaataaagaagactttgagtatcttttgctctcctctagatgcgttttaaaaactattccaaatttaattgatattgtattgagtttttcagggttattttaggcctgatttgataacaatgcgttgttttggtgcctccattaatgttgtattaaatcaatgggtcttttaaattgattaatatgtcattgaatcataccttctgattttctgtgatcatccaacggttaagtctttgccgttattgtcaatatatcaaccaaattttaaataactttttttactgtgtattactatattcaacgtcccagatataacaatattttgtattttcaccactgtttatggtattctcagaatgcgataaatcagggacttgggtaataaaatgtttctggaaaattcattacaatgtcaatctttgattatgcacaatcctgctgaggtgaatgtgattgtgaaaagtacttattaaatgtggaagttagtgtagagggcagtacccgtcttagagagaagtacagaaaaccacgttttgaaattgaatttaaaaaagaaaggaaaattgtgtaactcggctgtttctattttcataattaaaaacttttgagagtccttgccagttttgtaacaaagagaccaacaatcattaatgaaaaccttgtaaattattttagattttcaggaacaccatgccattccctcattttctacttgtcattcaggttgatttcaatgtgaaaatgttttgtgaacaaacacttatttttatcctatgtgttagcctcgcttcatagttaaaaagccgagttataaagctcttaattacatctcaattggtatcagcaatagacctaaaggagaggtattgattgttactaacctctgtttcctaatgagttaaagtaatgtcactcatgacatagattgataacaggcctgtagtcaaaacttactgtgctaatggacttatttatattttttaaaaattcaaactgtggtcttgaaccccaattctcagcttattaattatagattatttaattgtattagggatatgtcatgttatatttacttttggataaaacttgcattagatgcataataactcagtaagttttaaaaacaatgttaatttttccttgtttagaagttaagcaccttatcaagatattaagttttaaaatcttgttttataactttgtaacttgagagtaatggatgctgtagtgatgtctttcacatatgtgaagatgaacaataaaattgtttatttacaagta

SEQ ID NO: 346845 - DNA, 5065 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346846 - DNA, 4987 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346847 - DNA, 5299 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtaagagtgttcagtattcctagctacccaaagggttatcttcttgaacggtgactgatcaaaatatatttatatgtatattttttaaaaatgaactaattgtagggttatgtgctgatagccccaaatagcagcaagaaaaggaagcttagactgtaaaataaattatacatttgatttttgcttctttggtttagacctgctaaagttataggtcactagtttctgttccaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346848 - DNA, 4548 bp, Homo sapiens
  misc_feature (263)..(263): n is a, c, g, or t
gctattttagattttattcctgtgaaaatatatccatggaatacctgttattgaatatgcttcctattttatgagaggttatgcaatctaactcatttgattattaaatttgataacctaccatgttcagctatcatgtaaatattgttatctctatatttatgtttatgtagttacctgtgaaagtagctttgaaaatgtgacacatatttttattagtgtaattacattttaattaatttttaatacttcacatgttttgngtttttcctttggaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346849 - DNA, 4109 bp, Homo sapiens
ttatgttccgaaaatattatgaataatatattttaaaaaatgaatttagactgaaagttgacagcatccctttaaagacagcctattcaacttttagttaataatttgtggggttctttttggtttttcatttgtaatagaaatgttatatgttgcttaacaatgtttctggatactaaagttgcttaacagtcaaaatagaatacaagaacaaaaatgaagaagccaaaataaaaatatcaattttttattatttattcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346850 - DNA, 5657 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgcaaaacagtcagaaatttttattgccttttgagattctccaacttgacaaatgtgccaaagatcaacagacagaaaatatcatcctgtgtatttacttgtcatactttaactttgtgaaagatcttactgataaatgaaaagctttagcagaggtggtattgtggggtaattgcttaaatttacatatcaaagtaaaaaagtagtgcctgtattccatgtgtggagtaaatttgctaatgtctatattttatgattgatactattatttttcctttgcattttaaaatagtggctctaatattttccctgtcatggctacattctagacattgaatttatatcttctttttttcagatacggagcaaatagcatccttaacctatgaataatggtgttgcctagattcttgtcacacacacagaagaccctttgtacctagtaacattcatcctcttgattcctggtgaacacggttaaattcatgcacatttgttcttgtagtttctaaaaattagatcaatttatttgttagccagcaaattgaaaattccattattagattaatgaaatttttgctctgcttatatgtat

SEQ ID NO: 346851 - DNA, 3219 bp, Homo sapiens
tttttacctcctaccccacgggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346852 - DNA, 3110 bp, Homo sapiens
gacactttgagttacttataatagtgtatactataagatataaagcagtcataattacctaagcttcaaaaatcttttgtttccatgtccagagacaagtacagtacagtattcttatttgtttgctccccctttttaaaatatttaatagcttatgttcacttctcatagctcctttctttatgaaaaataacatgaaaatagaaaagttgttctaagtatactttttgtatatattctagacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcacactcaaaacttttagctttgatcacaagtggacaaatttctgaaaccaaaggcaactaagttgctgtgttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacatatcctaaaatttcagcttgcctttttgcggccttatattttgatgtaaagattaaaagaatgtgc

SEQ ID NO: 346853 - DNA, 2372 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaagaggcacctctggtactgaagattcctgctgattttgagaactggatggagaatactttcccatcaggggctggagagggagaagaaacctttttctacagaatcatcaggcatgggtaaggtggctaacgctgagatctctt

SEQ ID NO: 346854 - DNA, 2421 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtgaaatcccagcatccactaagctggtgttgtcctatcgacccagctggatcgtgtaaccagtctatgggaagtgaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggaatatcgaaaacagaaaaaaaagtgaaattggaagacaaaagctcaacagcatttggtaagagaaaagaaaaagataaggaaagaagagagaagagagacaaagatcactacagaccaaaacagaagaagaagaaaaaaaagaaaaagaaatctaagcaacatgactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaaacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgtgcaccgcgtgtgctgggccgaacc

SEQ ID NO: 346855 - DNA, 2048 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggacttcatgtagagaacgttccaaagatggtctttccacagccagagagcacattatcaaacaagaggaaaaataatcaaggcaactcgtttcaggcaaagagagctcgacttaacaagattactggtttgttggcatccaaagctgttggggttgatggtgctgaaaaaaaggaagactacaatgaaacagctccaatgctggagcaggcgatttcacctaaacctcaaagtcagaaaaaaaatgaagctgacattagcagttctgccaacactcagaaacctgcactgttatcctcaactttgtcttcagggaaggctcgcagcaagaaatgcaaacatgaatctggagattcttctgggtgtataaaaccccctaaatcaccactttccccagaattaatacaagtcgaggatttgacgcttgtatctcagctttcttcttcagtgataaataaaactagtcctccacagcctgtgaatccccctagacctttcaagcatagtgagcggagaagaagatctcagcgtttagccaccttacccatgcctgatgattctgtagaaaaggtttcttctccctctccagccactgatgggaaagtattctccatcagttctcaaaatcagcaagaatcttcagtaccagaggtgcctgatgttgcacatttgccacttgagaagctgggaccctgtctccctcttgacttaagtcgtggttcagaagttacagcaccggtagcctcagattcctcttaccgtaatgaatgtcccagggcagaaaaagaggatacacagatgcttccaaatccttcttccaaagcaatagctgatggaagaggagctccagcagcagcaggtaaaagaaaaaaaataaaggctcctataagtagataagtagctaggcttgcagttattaggtataaacattttgaggtttaactacattattttgattcctatataattccttttcataaatactttaacatttataggagagtttcatctccgttttaaaggtcttttgtgtgatcattttacaatcatattccctggacatacatgctgcttaaccttgtcacttgatctatttccttctccctgcttctttttta

SEQ ID NO: 346856 - DNA, 1824 bp, Homo sapiens
ggcacgaggcggcggaggcggcggcggcggcggcgatggcagcggaccctgagcgagcttgagggctcggacccagctccctcccgcgaaaccttgggcggatccggcgctgcggccccagctcgctccgctcctgctccctccccggccgctgcctgggcggaggcagaggcagaggcccgggctggccgccctgctcgtgccccagctcggccccggacggcccggctgctgtgcagagaggaggccgagtcgtgaaaagagaatactgaagaataggatctcaagatgagtaaaaagcccccaaatcgccctggaatcacttttgagattggtgctcgtttggaggcactggactacttacaaaaatggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgattttaaagctggagaagaagttctggctcgttggacagactgtcgctattaccctgccaagattgaagcaattaacaaagaaggaacatttacagttcagttttatgatggagtaattcgttgtttaaaaagaatgcacattaaagccatgcccgaggatgctaaggggcaggtaagagtgttcagtattcctagctacccaaagggttatcttcttgaacggtgactgatcaaaatatatttatatgtatattttttaaaaatgaactaattgtagggttatgtgctgatagccccaaatagcagcaagaaaaggaagcttagactgtaaaataaattatacatttgatttttgcttctttggtttagacctgctaaagttataggtcactagtttctgttccaggtgaaatcccagcatccactaagctggtgttgtcctatcgacccagctggatcgtgtaaccagtctatgggaagtgaggtaagagccttttttttaaaaattttgttttgtttttcctggtatataatgtcatttagaaagttaaaaatttttaatataaaaatttacattgagttcttatcttcttctttccttctacaaatcatagtcattcatcttcctttaaaaggcgcttacctgacactctgtaggctgtttcagatagggctctctgagtcatgtgatggaagcagtgtattgtatgctttgtcactgctcaaagcaagaatggatggtaagcattggaaggagaatcttgggtggaggtaaaaaccacaattccatttgttggctatgttttctgaaatactggaaagaaaggtgccattagaaatttaaaatattttcttttctattctgctgttatttgggattttcagcacctggacctacaattaattttaagaaattgaaagtagtgtgtaaaaatgtctaatatggaaatatgctacgtatttgttccataccatgcggtgaaaactgtcattctgaaatgtattgaaattacctggtcagcttcagtcaagtgtaaacatttagtgctctagaaatgtatatctaccacattaaaaaaattattcatgaagaaataagtgtgattgttttaaattgcctggttttcaaaaatttagttatgaaatgattagcaagcagatttcttctaattaatatgtaaatgcaatttaaaatgaaaatgcttttgatcaggaagtggctttgtgtcttcccacatgtatgtataaataaagtgttcttttaagcattcagtggtgt

SEQ ID NO: 346857 - DNA, 443 bp, Homo sapiens
cgccactgcactccagcctgggtgacagagtgagactccatctcaaaaaaacaaaaggataagtcatggcttaagtctggagctgccctgctctggtccgaggcattggtggtaactggactccatggtaatttggctggtgagaaagaactaagatcctgggaaggtgtcttgcttgctttcgactgcagtgattgtttcagaccagatggtgctgattcgagttcatgcgtcagtacctccactgcagtcctgagaagttagacaagaggcaatggggaggatgtgcagaggaaacatgaagggacacagtacaagccggtggtcacatcagctttattgcacttggagtattctgtttttcatgcgggatgataggtagcaacactgatgtgtggtttattgctctctgtgctttgcaaatgtctaaaataattttatta

SEQ ID NO: 346858 - DNA, 537 bp, Homo sapiens
cgccactgcactccagcctgggtgacagagtgagactccatctcaaaaaaacaaaaggataagtcatggcttaagtctggagctgccctgctctggtccgaggcattggtggtaactggactccatggtaatttggctggtgagaaagaactaagatcctgggaaggtgtcttgcttgctttcgactgcagtgattgtttcagaccagatggtgctgattcgagttcatgcgtcagtacctccactgcagtcctgagaagttagacaagaggcaatggggaggatgtgcagaggaaacatgaagggacacagtacaagccggtggtcacatcagctttattgcacttggagtattctgtttttcatgcgggatgataggtagaaaggattcagattgtggaagggtaaatggatgagatgaccattaaggtcttgttttactgagaggctgtaagtctgccagcgacagctgtcagtaaggctgcagaagggctggggggctacacaaggaagagcagagcaggacaaccagctgat

SEQ ID NO: 346859 - DNA, 376 bp, Homo sapiens
tttttttttgtagggatggggggtcttgctatgttgcgcaggctggtattgaactcctggcctcaagcaatcctcttgcctcagtctcccaaagtgattggattacaggcataagccactgcaccgggcctacatacatatttttacatgatccttaattcaatggccagcagggtttcatgcacacaaggtctgttcttgttttgctcagtaatgtatgctcacatttaaaatgatgccttcgtggttcctgaaggaatgtttgatgaatattcattcttctctttttgtatttgaactttaaaccaccaattcacaaatatccaacactgagttacagcactcagctcttcataaagaatctatctatctatca

SEQ ID NO: 346860 - DNA, 2655 bp, Homo sapiens
  misc_feature (49)..(49): n is a, c, g, or t
  misc_feature (131)..(131): n is a, c, g, or t
  misc_feature (133)..(133): n is a, c, g, or t
  misc_feature (136)..(136): n is a, c, g, or t
  misc_feature (143)..(145): n is a, c, g, or t
  misc_feature (1202)..(1202): n is a, c, g, or t
  misc_feature (1300)..(1300): n is a, c, g, or t
  misc_feature (2399)..(2399): n is a, c, g, or t
aaaacgaattaaggaagatgaagatgaattgtaaattatactctcaccnacaatagaaagggccaggaggtgctgaggcgaggagaggccgaactccaagggacgacgctcgcggaagcagaggtttgggntnctnatctgtnnncctcatctgtccggtgctgcgtttctcataggtcctgtgctcggtagtcttgcatgttcatctttgactagaagcagctctcctgggtcgtgtacccactaataatgtgggtggaaccacctagactccctcccgctctatctgagcaatggttggatcttctcttttagaacctgagcttgaggtctggcctcaggaagtggggagggtacagaagcagtaggaatgtgccatctcttcttaccagtcccacattttcccatcagtccacccaattacctgttcctgtgctgtatctgacccccctggcagggcttcccttgaatttccagccttcacccccacttcaaggcaagaccctctgtgggtcagtgtgatttcccctgacttgtagtctttctttgggcaggttcacatgtacttttggttaatatctttcaagagatctaagtggctcctaagacatacttatccctctcttcttcagcctgtcctcagaaggtcaccctttctcattagaaagctgggacagtgaaaaaaacaaagagggaaccctctgccaagtcccacccttgctgccagtcctcacccctccaaatcaagcctggccaggccttcaggacacgccaggtcatttccctcacattacgggagatgtacagactctcaatgatctctttcagtttgtctacacttaatcatatgtagcagatctcagagttctagcatggaatttggccactctcttgtttcaataagttgtctttatatattgagctattttttgcttttttcctagagtgccaaggagttattatgcaaatgagtacttactccacttctttccaagaagttcttcaactgctatatattttaaatagtgagaagataaaggtaaaatatgtcagaaggttaagaggaacatattttttaaaattagaaagttaggactagaaaagataaaagaaatgagtaaatagattaaaattaacagtgaggagacaaaatctgaacagttttagaagtcagagaatttgatgaaagtgcaaaaaaaganctctaagagtaacgatgccaaaaagataaaattaaatgagagaaaaggtttaaaaaggctagcctttcaaatttttaataaaatcttaaagtttaaanggctagaaaagaacatggtaagataattaaatcatcttagtatttaaagattaaaaagctaaaaagaatgtaaacaatgtattctgtaatattccaaattaaggatgcatgtatatttactgatgtagaaagatgtgtaagacctctagtttagaaagaaaagcaagtcacagaacattgtatagtccaagcgtatatattgcataaaggtttgcagatagagaaaagaatggtaggaagccaaactactgaagtggtagggagctactgaagaggaaagggagtggggtggggggtgtcatggacatcgtcagccagtccccttaggtgccctcaggtccctttaccgtttctgtgctctttttcccatcctgagtgccatgcaccgccagccctcacaatggtaactcgcaggtgaactgcctttgcacccttgcaccccacatgtgtagacagcttgaaggattcacttgggcctttacatcaccccatcctcactcccaccctgtggccctcagccagtaactgaggctgcaggaaatggaagcctcgccccttgtctcaggtggggacaactctgagatgtcagttgccttgagcagcagtgtccaaaatataaagcaacctacatatgtgactttacattttctagtagccacattaaaattcattttaataaggggctaggcatggcattcatgcttgtaatcccaacactttgggaagtcgaggtgggaggatcacttgagctgaggagtttcagaccactgtgggcaacatagggagacccatgtctatacaaataatgttttaaaaaattagccagatgtgatggtgcacacctgtggtcccagctactcaggaggttgaggcaggagtatctcctgagtctgggaagtcaaagctatagtgagttatgattgtgccactgcactccatcctgggtggcagagtgagaccctgtctcaaaaaaattttttttaattaaaatcattctaacagtgtatttatatcattcaacatgtaatcagtgtgaaaaactattaatgagatgttttgaattcatttttatttgtactaagtcttcaaaacccagtgngtaacacacttcacttgggatgtccctatttcagttgctcagtagtggctagtggctacccagtcggacagctcagcgtcagtcacatggaagctgttcctccgcagggctctgcctgaaactgaagtctcactgggtttcttctcgttccctgtcctgcttcctccactccctcatcggtatcttgagagcactgcttaataaatcttttgcatacaagtattatctttgtaattaaaataaatctgggaggttc

SEQ ID NO: 346861 - DNA, 4206 bp, Homo sapiens
cggccctcccatgtgcagcccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggaaattccacttacttggatgaccatggaccacctcctagtaaggtactacctttcccaagccaggtggtgtacaacagggtaggcaagtgtgggagccgtactgtggtcttgcttctgagaatcttgtcggagaagcacggatttaatttggtcacatcagacattcacaacaaaaccaggcttactaaaaatgaacaaatggaactgattaaaaatataagtactgccgaacaaccctatttattcactcgacatgttcatttcctcaacttctcaaggtttggaggagaccagcctgtctacatcaacatcattagagaccccgtcaaccggttcttatccaactattttttccgtcgctttggagactggagaggggaacaaaatcacatgatccgcacccccagcatgaggcaggaggagcgctacctggatatcaatgagtgtattcttgaaaactatcccgagtgctccaaccccaggttattttacatcattccgtacttttgtggacagcatcccagatgcagggagcctggtgaatgggcccttgagagagcaaagctgaacgtgaatgaaaacttcctgctcgtggggattcttgaagagttggaagatgtgctgctgttactggaaagatttttacctcattacttcaagggcgtgctcagtatctacaaagacccagagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttaagtctcacgtcagcaagccccccctgaggccacacttctttatcccaactccactggaaaccgaggagccaatcgacgatgaagaacaggatgatgaaaagtggctggaagatatttataagaggtgatgtgactgtgttgcctctatggctttatctcccttttccagaaagttctttgtttggggaagtaaaatccttaagggactaaattaatgcttgggtgcattaaaaagaacaaaacattcccacatgttggggtcattgggagatgcccggttttgcgggttttatttgtttaattttattctgtgttttctcttggctctttgggtctttcccgggtacactagatggctccatcccaaggcatcttgtcataaaacagctttcccccaccccatatcatgggaaaagggggagaaatatagcccctagcctaataacttatcatttgtaaaatgacttataaaaatattacctcaatggtaggagacatccagacttgtatatttcagtggaaatacaaaaccacttcagagaccagggtatctcctctggaaggatctaagagaaggtaagacagattaggacatcgaaaaggaggatggagccaggtgccatggcttgagcctataatccgaggctgaggtgggaggatcacttgagcccaggagtttgaggttgcagtgagctgtgatcacaccactgcactccagcctgggtgacagagtgagactctgtctcaattaattttttttttttaaaggaggaggatctccatgggtaagtggtttctacccgcatgggtagagttctgcctctggtccttctcagggggcactttcaccaagagcagtgtaattatctctgaaagagcaagtcagcttgtgccgcatccccaaccaatccacagcctggagtacctttcaaggtcaaagtgcatggccagctccattgagacattccatttcaaagcaccgtgctgacagatatcaaagtactctagcagggaaaataatttgtttgctgtgtaaggaagaatgtagacaagacagataaatctgaaggtcatgtggcatcagggaaagggcatggctgtgtcttttgcacccaatatgaaacatcttctcccaacactgctttaatggaagttctaggaaccaatttagctcaggcatttgactcctacagcagaagttctgagcctgaccacagatggtgtgtaatctatcaaacacacccctggccaagttgggtcctataggacctggtactatgtactattgtaacttctagttccctaagaggtacctgttttcagtaaaaaggggtcctgagttctgtgcaggtggaagagctacccgagaactacctgagttctgtgcaggtagagtcccatttcttatgggacctgtgtgctcctgagaactcttacttgagacatcaaaaagaagcagcaagagcttctgggacagagactgcttggccagctttgtaagtaagtggctgcctccaatgtgatgtgagtacatgttgggcagtctcactgtcctaaggtatgtcttctttccacctcccactgcccctcccctgccacctatcaatgatgccttggttcagtcattagaaatctgttgctttgagttctgaaatattttcaccttaaaaaaaatgctgaaaatacacattctcctgggaagacgataaacagctagctaagaagccgaggttcagtggtggcagcaggaaggacactgccacaaattttgtctatttcatatttgtcccctagagccagccctagcaaatgtgtgagttgggagtagttaatagtaaataagactctgactttacacaagctacacattttatacttttcataaaccacaaagtctctctagaattttttctgccttcactaaaattggactgtagccaagatataaagcaagtcatttggaacctgccgagtgagcactgaagctactttatcatgagatgtgtgttaagaaggctgcagcccacaggagtccagggaaggcggggaccacagaggcacagagtccagcacttggccgctcatgggccttctttctgcctcagaggacgggggcagagaagtgatgaagggaaatgttcttagaggaggaaatatcctttgtcctgttcagagagaccagggccctaccattaggcatactttcagaagcaacctggagaacagctatcaatcatattcaaaaccagtacaagaactgctgcctggtaccctgtgagtcatttctatgaaattccatataaagaatgatgataagtttacacactgtgcaatctcacaatctgaaaataaagttgagttggctgtgttttctctgctcttgtcagaacattgggacaattggtcgttcaaaaacattcatcctcttactgcaagtttatctgggtacttttacctgtgtgttcaaaggcatttcttttcagcagtgatcattataacttcacaaaaaaagatgctgacggatttacttacagggccttaatgttattttgtcccagccaacaccctctaggtcctaaaagtcaaggtacttcagtttatttggcaaacatgacaacattttttttggccctgggcccaacagtttgtacttcatgaaacatattgtacattttacatagtttaatttaaaaaataccttttaagctagttgatctttgactgtcttatttattataacctttcagcacattccaaggttttagttactcaggaaggagttaattaaaatgattttattttggtctgatggatgttttttaaaaggaaaattattattatgaaccttcagcctactttcttgagtgccgtaaaagtgcttgtaaatctttttttttttttaagaagaaagaaaaaaatggtgtttgacgttgatggaaattcaaaaatatatatggaactgaaacattaacttagctaaaataaaagcaatctgtgtttgaaaaaaaaa

SEQ ID NO: 346862 - DNA, 3245 bp, Homo sapiens
tgtgaggcgccctctgagctaccaacaaggaagcgagagtaactgaatggagtacagaaggaacagaaagcaggttttgagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttaagtctcacgtcagcaagccccccctgaggccacacttctttatcccaactccactggaaaccgaggagccaatcgacgatgaagaacaggatgatgaaaagtggctggaagatatttataagaggtgatgtgactgtgttgcctctatggctttatctcccttttccagaaagttctttgtttggggaagtaaaatccttaagggactaaattaatgcttgggtgcattaaaaagaacaaaacattcccacatgttggggtcattgggagatgcccggttttgcgggttttatttgtttaattttattctgtgttttctcttggctctttgggtctttcccgggtacactagatggctccatcccaaggcatcttgtcataaaacagctttcccccaccccatatcatgggaaaagggggagaaatatagcccctagcctaataacttatcatttgtaaaatgacttataaaaatattacctcaatggtaggagacatccagacttgtatatttcagtggaaatacaaaaccacttcagagaccagggtatctcctctggaaggatctaagagaaggtaagacagattaggacatcgaaaaggaggatggagccaggtgccatggcttgagcctataatccgaggctgaggtgggaggatcacttgagcccaggagtttgaggttgcagtgagctgtgatcacaccactgcactccagcctgggtgacagagtgagactctgtctcaattaattttttttttttaaaggaggaggatctccatgggtaagtggtttctacccgcatgggtagagttctgcctctggtccttctcagggggcactttcaccaagagcagtgtaattatctctgaaagagcaagtcagcttgtgccgcatccccaaccaatccacagcctggagtacctttcaaggtcaaagtgcatggccagctccattgagacattccatttcaaagcaccgtgctgacagatatcaaagtactctagcagggaaaataatttgtttgctgtgtaaggaagaatgtagacaagacagataaatctgaaggtcatgtggcatcagggaaagggcatggctgtgtcttttgcacccaatatgaaacatcttctcccaacactgctttaatggaagttctaggaaccaatttagctcaggcatttgactcctacagcagaagttctgagcctgaccacagatggtgtgtaatctatcaaacacacccctggccaagttgggtcctataggacctggtactatgtactattgtaacttctagttccctaagaggtacctgttttcagtaaaaaggggtcctgagttctgtgcaggtggaagagctacccgagaactacctgagttctgtgcaggtagagtcccatttcttatgggacctgtgtgctcctgagaactcttacttgagacatcaaaaagaagcagcaagagcttctgggacagagactgcttggccagctttgtaagtaagtggctgcctccaatgtgatgtgagtacatgttgggcagtctcactgtcctaaggtatgtcttctttccacctcccactgcccctcccctgccacctatcaatgatgccttggttcagtcattagaaatctgttgctttgagttctgaaatattttcaccttaaaaaaaatgctgaaaatacacattctcctgggaagacgataaacagctagctaagaagccgaggttcagtggtggcagcaggaaggacactgccacaaattttgtctatttcatatttgtcccctagagccagccctagcaaatgtgtgagttgggagtagttaatagtaaataagactctgactttacacaagctacacattttatacttttcataaaccacaaagtctctctagaattttttctgccttcactaaaattggactgtagccaagatataaagcaagtcatttggaacctgccgagtgagcactgaagctactttatcatgagatgtgtgttaagaaggctgcagcccacaggagtccagggaaggcggggaccacagaggcacagagtccagcacttggccgctcatgggccttctttctgcctcagaggacgggggcagagaagtgatgaagggaaatgttcttagaggaggaaatatcctttgtcctgttcagagagaccagggccctaccattaggcatactttcagaagcaacctggagaacagctatcaatcatattcaaaaccagtacaagaactgctgcctggtaccctgtgagtcatttctatgaaattccatataaagaatgatgataagtttacacactgtgcaatctcacaatctgaaaataaagttgagttggctgtgttttctctgctcttgtcagaacattgggacaattggtcgttcaaaaacattcatcctcttactgcaagtttatctgggtacttttacctgtgtgttcaaaggcatttcttttcagcagtgatcattataacttcacaaaaaaagatgctgacggatttacttacagggccttaatgttattttgtcccagccaacaccctctaggtcctaaaagtcaaggtacttcagtttatttggcaaacatgacaacattttttttggccctgggcccaacagtttgtacttcatgaaacatattgtacattttacatagtttaatttaaaaaataccttttaagctagttgatctttgactgtcttatttattataacctttcagcacattccaaggttttagttactcaggaaggagttaattaaaatgattttattttggtctgatggatgttttttaaaaggaaaattattattatgaaccttcagcctactttcttgagtgccgtaaaagtgcttgtaaatctttttttttttttaagaagaaagaaaaaaatggtgtttgacgttgatggaaattcaaaaatatatatggaactgaaacattaacttagctaaaataaaagcaatctgtgtttgaaaaaaaaa

SEQ ID NO: 346863 - DNA, 444 bp, Homo sapiens
atgtaaacccaggcgaagcagagctcttctggcttgggtagggcaggaggtcttggagccctgcccatccagcacctccccaacagaccctctgtgtatgttgacgtttccttttactgggaactccttacatccctctcttctgggtccaggatcagccatagaattggagagggttgagcggccctggctgtagaggaaagaagactccagaagctggagaagaattcgggatctgacaggaagttcaaggtgacctctgggagccttctgagaagaaaaagggcatgcaacctcagcagtgtctctctgcctctcaccaaattgacagtgggcccgaactttgctcatttaatgagatagaattagtaaagtctccagtgtacttttcattccttccacaagcttttaccgaataaaatgattggtactcagtaaaggtta

SEQ ID NO: 346864 - DNA, 1070 bp, Homo sapiens
cggccctcccatgtgcagcccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggaaattccacttacttggatgaccatggaccacctcctagtaaggtactacctttcccaagccaggtggtgtacaacagggtaggcaagtgtgggagccgtactgtggtcttgcttctgagaatcttgtcggagaagcacggatttaatttggtcacatcagacattcacaacaaaaccaggcttactaaaaatgaacaaatggaactgattaaaaatataagtactgccgaacaaccctatttattcactcgacatgttcatttcctcaacttctcaaggtttggaggagaccagcctgtctacatcaacatcattagagaccccgtcaaccggttcttatccaactattttttccgtcgctttggagactggagaggggaacaaaatcacatgatccgcacccccagcatgaggcaggaggagcgctacctggatcagccatagaattggagagggttgagcggccctggctgtagaggaaagaagactccagaagctggagaagaattcgggatctgacaggaagttcaaggtgacctctgggagccttctgagaagaaaaagggcatgcaacctcagcagtgtctctctgcctctcaccaaattgacagtgggcccgaactttgctcatttaatgagatagaattagtaaagtctccagtgtacttttcattccttccacaagcttttaccgaataaaatgattggtactcagtaa

SEQ ID NO: 346865 - DNA, 444 bp, Homo sapiens
ttgtggtaggtactaggtctacgttggagtgtggaaggttttcagatctcacaaagcttagaaactcatgcatctgttaaatacaggtctgtgcattaggcacgtgcaggggctgtgggcacagagatgaagagtgaattccaaagaactcaaacctgtgtggagaagtcagagaaagggtcactgataatggtcctaggagaggcaaggtggtgtgataaaagtctgcacagaggaaggggccctcagacctgggcaggtgcgtgcatcctggagaagatgatacctgaattgagttgagaaggtactgtaggaattaactaggtgaaagaaataggagagggtattcctggataaagaaacagcaaaagcaaaggcaaggaagcctaaaggcttgcaggagtggctgggaaaccgcacatggattactcccataaatgttac

SEQ ID NO: 346866 - DNA, 482 bp, Homo sapiens
cccaaaataagcaggcttaggaatttgcaaaagagtcaaagcttttccttaactaaattcctgaatgacatttctcatcttggacactacatttgagacttcgatgataaacgaagttcttgacaagatttttctataataaattcaggacagtttttcatgtggatattcttggtaagactcttcagtaaaagctgaagccataatggcaaagggcttttcaacgagaggattctagattcaggtgtactgcattttcatagaaatgggcttttagtgacagtgcatatatccacctgttatttccctctgatagagagaccttcttctgactttttcaatcaaatttgttcttattttccataatgaacaaggttagcttcaacatgactctaccagcctagacatataggcctagactttaaccagttaacccaaacattgtgctaccagagtcctgtttagataacttagtgagcctc

SEQ ID NO: 346867 - DNA, 3771 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctca

SEQ ID NO: 346868 - DNA, 1002 bp, Homo sapiens
ttgttgttgagttgtaggagttcttaatagtttctggatatcagatgcctttgtggttttcacatctctgcaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatcaaacctgttggaatttctaagtctctctcgatggcccactcaggttagcagcatgcagctcatcctaccccgtcaacgttgactggaagggtttttagtccctgtgttgagccacatctgcagcttgtgcaatgcaaaaccaaggaaaagaaaatggaccccccccgccccccccttgatggatctagctgagactaggcactggccaggctgtcacctacagtggtttcaacctcctgctgccagcaagacagcatctcctgtcctttttgtgcaggaaccatagctctgttgggttaagtgttttcctctaccaagcagctaacctggccttgaaacctaatctctgatgccatgtccccccaagccccatcagagttttgtaaaaagcccctccctgctctccacaccaatgctgagagcccatggggtaactggaggcttccctgccatcttggcaaagaagcctggctgacgtcctgcacatgcttccccaggtgattgcttgcacttaacagcagaggaaacgagaccaccccacacaacttgtagcagttgaggagtctctgcctgatcccaccccggatacttagagcatccagaattaaaaataagccttgtcaccaacatccggctcccccactccccagagccaggctcaatgtgcccaacagcgctggggcccg

SEQ ID NO: 346869 - DNA, 617 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccaggtaggtgctaaaatatttctaaaatatttcaatcataagcaagagaaagtagtcagcctcgtcatatgtagaatatgtcgctgtcttaagaataacaactgttaacaacctaaaggttcctggatatggggtgatcactttataatttatgaggagttctctttttaataaaatatggtcccatctcagctcttcattac

SEQ ID NO: 346870 - DNA, 5675 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaaatttaaaaatttaaaaaaataaaaagaatccaaccccggcagggcgtggaggctcacacctgtaatccagcacttagggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatcaaacctgttggaatttctaagtctctctcgatggcccactcaggttagcagcatgcagctcatcctaccccgtcaacgttgactggaagggtttttagtccctgtgttgagccacatctgcagcttgtgcaatgcaaaaccaaggaaaagaaaatggaccccccccgccccccccttgatggatctagctgagactaggcactggccaggctgtcacctacagtggtttcaacctcctgctgccagcaagacagcatctcctgtcctttttgtgcaggaaccatagctctgttgggttaagtgttttcctctaccaagcagctaacctggccttgaaacctaatctctgatgccatgtccccccaagccccatcagagttttgtaaaaagcccctccctgctctccacaccaatgctgagagcccatggggtaactggaggcttccctgccatcttggcaaagaagcctggctgacgtcctgcacatgcttccccaggtgattgcttgcacttaacagcagaggaaacgagaccaccccacacaacttgtagcagttgaggagtctctgcctgatcccaccccggatacttagagcatccagaattaaaaataagccttgtcaccaacatccggctcccccactccccagagccaggctcaatgtgcccaacagcgctggggcccg

SEQ ID NO: 346871 - DNA, 4990 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaaatttaaaaatttaaaaaaataaaaagaatccaaccccggcagggcgtggaggctcacacctgtaatccagcacttagggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatca

SEQ ID NO: 346872 - DNA, 4009 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgaggtcaggagttcgagaccagcctgaccaatatgatgaaaccccgtctctaaaaaaatacaaaaattagccgggcgtggtgtcaggcacctgtaatcccagctactcaggaagcagaggttgcagtgagctgagatcgggccattgcactccagcctgggcaaaaagagtgaaactctgtctcaagaaaa

SEQ ID NO: 346873 - DNA, 3674 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaaatttaaaaatttaaaaaaataaaaagaatccaaccccggcagggcgtggaggctcacacctgtaatccagcacttagggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctctaaaaaaatacaaaaattagccgggcgtggtgtcaggcacctgtaatcccagctactcaggaagcagaggttgcagtgagctgagatcgggccattgcactccagcctgggcaaaaagagtgaaactctgtctcaagaaaa

SEQ ID NO: 346874 - DNA, 1080 bp, Homo sapiens
  misc_feature (163)..(163): n is a, c, g, or t
  misc_feature (272)..(272): n is a, c, g, or t
  misc_feature (386)..(386): n is a, c, g, or t
gaagcccatgatcacatgcactgctctccagcgtgtgtgacataaatatgacgcctgttctcatagttgttctatatgtgacacgaatccactgcttctcggtagcatctgaccatgctagagtgcacagggtgtggggaacttttgcaaaagcaatgggatntcgagtcagtgctggctggagcttcgccctggcaggtctcgtcagcctctgttgcttctagggatgatcaccttgggtgattccactgttggcacgaagacgccggctntcactcgcacttgttccacgatggatataggactatttgtagcactcaagtaactttacttctagctccatctataatgtgctcccttcaagtagctagaagaattgttctaantggaaatgggttcatgcattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctctaaaaaaatacaaaaattagccgggcgtggtgtcaggcacctgtaatcccagctactcaggaagcagaggttgcagtgagctgagatcgggccattgcactccagcctgggcaaaaagagtgaaactctgtctcaagaaaa

SEQ ID NO: 346875 - DNA, 1333 bp, Homo sapiens
  misc_feature (1265)..(1265): n is a, c, g, or t
  misc_feature (1289)..(1289): n is a, c, g, or t
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaaggggtacatcaagcttntcccccgaacaggaaaccaaaccntttttttcccaagaagacctttaaaaccctggacccggtggttt

SEQ ID NO: 346876 - DNA, 371 bp, Homo sapiens
ggacaagtcacagattattaacagcatctcaaagcagaacaatttttcttagtacagatcaaaatggagtttctttatgtcttcctttttctactagacacagtaacgatctgatctctcttttccccacagttactagctaaaattaactccatcactatttctgacagtacactcagtttaaaggttatggtgatgtttcctctttagacactgtacaccattgatttaacctaataggtaaattggtcatctcacagcttcttgaactggtttgcctttatttcaaggggctttaagaaaagtgagtcctttatgatggagggcagtgtgatttgactttgaccttggtaacaccttgtgttctgcag

SEQ ID NO: 346877 - DNA, 908 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaaggtagggtcttttggaagacatatggcactgagtcaaaccacagagtcaaacagagtgatttctttgtttttaatgcattggcatttggagataaggttttccaccaaagtcactaccatgatttaaaaagctggttcccacccattgtataaatgtggctaagtggccaagggactgaagtaaactttttttatgaatggtagttgtttaaatcctaggaataaaggctggacatggtggtttatgcctgtaatcccagcaatttgtggggccaaggcaggatcacatgaactccaggaatttgagaccagcctgggcaacatagtgagaccctatctctc

SEQ ID NO: 346878 - DNA, 5292 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaaatttaaaaatttaaaaaaataaaaagaatccaaccccggcagggcgtggaggctcacacctgtaatccagcacttagggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctctaaaaaaatacaaaaattagccgggcgtggtgtcaggcacctgtaatcccagctactcaggaagcagaggttgcagtgagctgagatcgggccattgcactccagcctgggcaaaaagagtgaaactctgtctcaagaaaa

SEQ ID NO: 346879 - DNA, 4207 bp, Homo sapiens
atcacttactgtgttgctttcatccctcctggagaatagaagtttcctactcccatgtacctgatggctgacaagatcctctcaccagttcatgggagctaccctgattggaactctttcagcagcagccatggcacaccctcataactctcccacagtacccttagaatactgcaacgcgttgattaggctgtctccgagcgcattggccggtactacaccgcctgcgcgagggtccctccgcccgacagcaatccatggagcgggtgtggctcactgcaggcactgtcaaggcaacccagaatgtgagcagagcctccaccttaaccaattcaacccacccaattaccaccaaactaaattcatcgggacaggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgtggcggtgtgcgcctgtagacccggctactcaggaggctgaggcaggagaattgcttgaacccgggaggcggaggttgcagttagctgagattgcgccactggacgacagagcgagactcagtctcaaaaaaaaatttaaaaatttaaaaaaataaaaagaatccaaccccggcagggcgtggaggctcacacctgtaatccagcacttagggaggccaaggctggaggattgcttgagatcaggagttcaagaccagcctgggcaacatagttagaccttgtctctatttttaaaaatataacaagcacagttgtacacgtctttagttcagctgctcaggaggctgaagtgggaggatcctttgaacccaagagtttgaggctgcagcaagccatgatcacaccactgcactccagcctgggtgacagagtaagaccctgtctcaaactttttttaaaatgaaagaatccaacctttttttactctgacctgcgagagtgcagagggtctggggaacatttgcagaagcaacaggtaccagccagtgctggaaggagctcaccctgggaggtctcgtcagcctctgtccttcatggctgtcccttgtgtcccatgtggagagcccttcctccctttccacatggtaagcactgagcccaatttcttctcaccccacagatggtccctcagagcagagatgtctaatgaaaggttcagattcagatcactaactttccatcttccactttttccagtggtggccatgttcccccgtttgccttcacaaaaaccttgtgaataatacaagccatatggactctgatttacagtttagaagatgagcagaggtgggtgtgagttgcccagtcatgttgctagttgttgaagaaactaggattgttctcaggtcttgggctcctggcccatagaccagtggctctgtgttctgatggggtattggggaggatttttacaaatgcaggttcctgagattgttcctggaacatctccgagtgggtgtgggttgtggccctgcgtgtgtgattttgcctatcccagctccggggtaccaccaaccactttttgtctctgtgggtttacctactctggatattttgtttaaatggaatcataccaggctgggcacagtggctcacgcctgtaatcctagcactttgggaggccaaggtgggcagatcacctgaggtcaggagttcgagaccagcctgaccaatatgatgaaaccccgtctctaaaaaaatacaaaaattagccgggcgtggtgtcaggcacctgtaatcccagctactcaggaagcagaggttgcagtgagctgagatcgggccattgcactccagcctgggcaaaaagagtgaaactctgtctcaagaaaa

SEQ ID NO: 346880 - DNA, 4216 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggcgctggcctacagcaccatcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcaggtggtggccatgttcccccgtttgccttcacaaaaaccttgtgaataatacaagccatatggactctgatttacagtttagaagatgagcagaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttgcctcatccgtaatggggtgtccttgttcatattgaggctctctagtgaaggcttacggtcaggcacgactgcaaattaaagcttcacaaatcaaacctgttggaatttctaagtctctctcgatggcccactcaggttagcagcatgcagctcatcctaccccgtcaacgttgactggaagggtttttagtccctgtgttgagccacatctgcagcttgtgcaatgcaaaaccaaggaaaagaaaatggaccccccccgccccccccttgatggatctagctgagactaggcactggccaggctgtcacctacagtggtttcaacctcctgctgccagcaagacagcatctcctgtcctttttgtgcaggaaccatagctctgttgggttaagtgttttcctctaccaagcagctaacctggccttgaaacctaatctctgatgccatgtccccccaagccccatcagagttttgtaaaaagcccctccctgctctccacaccaatgctgagagcccatggggtaactggaggcttccctgccatcttggcaaagaagcctggctgacgtcctgcacatgcttccccaggtgattgcttgcacttaacagcagaggaaacgagaccaccccacacaacttgtagcagttgaggagtctctgcctgatcccaccccggatacttagagcatccagaattaaaaataagccttgtcaccaacatccggctcccccactccccagagccaggctcaatgtgcccaacagcgctggggcccg

SEQ ID NO: 346881 - DNA, 2673 bp, Homo sapiens
ggcggctgcggcacgggaaaggctcagtgactgaagctccaaaggccagcaggctggtggggacgtgaccgaagcgaggctctggttccctttcggtgggcgccatttgagcctcatctctggcttccccaggatgcgccggcagccggggagcggctccgggcgcgaggtctgaggatgatctttcctgtcgcccgctacgcgctccggtggctgcgacggcccgaagaccgtgccttttcccgcgccgccatggagatggccctccgaggcgtgcggaaagtcctctgtgtggccgaaaaaaacgacgcggccaaggggatcgccgacctgctgtcaaacggtcgcatgaggcggagagaaggactttcaaaattcaacaagatctatgaatttgattatcatctgtatggccagaatgttaccatggtaatgacttcagtttctggacatttactggctcatgatttccagatgcagtttcgaaaatggcagagctgcaaccctcttgtcctctttgaagcagaaattgaaaagtactgcccagagaattttgtagacatcaagaaaactttggaacgagagactcgccagtgccaggctctggtgatctggactgactgtgatagagaaggcgaaaacatcgggtttgagattatccacgtgtgtaaggctgtaaagcccaatctgcaggtgttgcgagcccgattctctgagatcacaccccatgccgtcaggacagcttgtgaaaacctgaccgagcctgatcagagggtgagcgatgctgtggatgtgaggcaggagctggacctgaggattggagctgcctttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaacctgacggtgttggtggaacagcagacccccgatccacgctggggggcctttgcccagagcattctagagcggggtggtcccaccccacgcaatgggaacaagtctgaccaagctcaccctcccattcaccccaccaaatacaccaacaacttacagggagatgaacagcgactgtatgagtttattgttcgccatttcctggcttgctgctcccaggatgctcaggggcaggagaccacagtggagatcgacatcgctcaggaacgctttgtggcccatggcctcatgattctggcccgaaactatctggatgtgtatccatatgatcactggagtgacaagatcctccctgtctatgagcaaggatcccactttcagcccagcaccgtggagatggtggatggggagaccagcccacccaagctgctcaccgaggccgacctcattgccctcatggagaagcatggcattggtacggatgccactcatgcggagcacatcgagaccatcaaagcccggatgtacgtgggcctcaccccagacaagcggttcctccctgggcacctgggcatgggacttgtggaaggttatgattccatgggctatgaaatgtctaagcctgacctccgggctgaactggaagctgatctgaagctgatctgtgatggcaaaaaggacaaatttgtggttctaaggcagcaagtgcagaaatacaagcaggttttcattgaagcggtggctaaagcaaagaaattggacgaggccttggcccagtactttgggaatgggacagagttggcccagcaagaagatatctacccagccatgccagagcccatcaggaagtgcccacagtgcaacaaggacatggtccttaagaccaagaagaatggcgggttctacctcagctgcatgggtttcccagagtgtcgctcagctgtgtggcttcctgactcaggtgctgtaggccagcggggacagcagtgtgtgtccagtttgtcagccacaccctgtgtacaggtgagctgggcacctgagtcaggtgcctcctctggagtgtgtacaccatctttcccttgctcctgccagaacccagagaggagtgtcggggattccactcaggccctgcaggggcgtagctgtgttctgcagcagccagttcagcagggctggtccagttctgttgtgttccatgctgtcactgctttggcaggtatgaccctgtttggagtgggccatgggcaaagaaccatgaagggctctttccctgccctctccagatagatgattgctacaccaggcttaggaaattattcacatattaaatacaacatccaagcttgggctacgtagcaagaccccatctcttta

SEQ ID NO: 346882 - DNA, 389 bp, Homo sapiens
aggttgcagtgagccgaaattgtgcccctgcacttcaacctgggcaagggagccagactcccatctcaaaaaaaaaaaaaaagagaagtcttgggaaggaggacagtggagacacacagggaatgatccaactgaagtaagcttcagcactcagtaagtgtccagctctgttctttccacagactgcctccttcaattttcagccagttttgtggctaggtgttaaccccattttacaggtgggagacattgaggctgactgatgaggttagtttctcagccacccttctaagatctaagtccacttttgagcaagtgctctgaataacaataattatcttacagcttaatgtacgattattaaataccactcccctttcattttacca

SEQ ID NO: 346883 - DNA, 1033 bp, Homo sapiens
atagatacattgaataagaatctttatttcattcccagtgtggtttggagtataagacttaggaaagtgtctgtgaaacctacagtgagaaattccactgggtcttgacagctggagtgagcactcaaatgtgcccagcacttttctctagctcccttctctgcttgagctgtggtctgctttctccttctctgtagctcagatcatcttcctccacttctcagcccacatgtctaacgtggctgggaccagctcagagtgtttcaaatgtgtaggtgctcggagagagagagacccaaccctcttagactcaggtacacattctcagggaagaaaactggaaccagtagaaatatcagatccctatgttccctgacgagtgcttccttctctaagaagaaaaacctactaagaagacaaattacagctggaaggttgtttggtaagcgtggaatcacctatctaatctcccagcaagtcttaattgctctaccataaaaaaaaagcaacccaaatccatccttttcccagcttcactccagcctgggcaacacagcgagactccgtctcgaggaaaacaaaacgaaaagacgcgtgcctgcggtgaggaagctgggcgctgtcttcgagttcaggtgaattagcctcaatcccccgtgttcaccttggactcccatagccctcttgcatggatcacgtaaacactgaaaggcagccggggagcagacaacagatgaggtctacaactgtccttcatggggatttcaacgctatggttatattagcaccaaacttctacaaaccaagctccagggcccaaccctagcaagggcccaaatgagagaatggtacttacggatgcgaaaccggagcctggctagacgctctcggatgctgtgtgcctgacatgagtgtactgcctaccatatgtgctgattatatggctttgcacggtgcttgtaactcatggcaacttgttgcttaatatatgtatgtatatctctttactgcacacttatatataatatcaaca

SEQ ID NO: 346884 - DNA, 4185 bp, Homo sapiens
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatacagttctgaccttttttgtccagtttctttgggggaaggaagacaaagaaggtaggaacggaattttgagggcaaagaaacctgtgtttccatggaattgctgagacgtggctcctggggctatttctccctaataaaggatgatccaggtcctcatttccaaagtcccaatgctctgaaaaccaaaagtattttcataacccatttgaaaccaaacctgacctgaacttacactgataggaagctatgggtaattatgatgtgttccttttagtgtgattctttgttgcagaaatgtcaatatattttatgacatggttccctactagggattatacagtatttgctgactacttcctaagagccaaaaataaaaaatctgaattcc

SEQ ID NO: 346885 - DNA, 4348 bp, Homo sapiens
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatacagttctgaccttttttgtccagtttctttgggggaaggaagacaaagaaggtaggaacggaattttgagggcaaagaaacctgtgtttccatggaattgctgagacgtggctcctggggctatttctccctaataaaggatgatccaggtcctcatttccaaagtcccaatgctctgaaaaccaaaagtattttcataacccatttgaaaccaaacctgacctgaacttacactgataggaagctatgggtaattatgatgtgttccttttagtgtgattctttgttgcagaaatgtcaatatattttatgacatggttccctactagggattatacagtatttgctgactacttcctaagagccaaaaataaaaaatctgaattccaaaataatctagtgccaagggcttgggataagaaatgtggacctacaggctgggtgcagtgactcacaccagtaatcccagcactttgggaggctgaggtgggtgaattgcttgaggtcaggagtttgagaccagcctggccaacatggcgaaacctcgtctc

SEQ ID NO: 346886 - DNA, 4295 bp, Homo sapiens
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaaatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatacagttctgaccttttttgtccagtttctttgggggaaggaagacaaagaaggtaggaacggaattttgagggcaaagaaacctgtgtttccatggaattgctgagacgtggctcctggggctatttctccctaataaaggatgatccaggtcctcatttccaaagtcccaatgctctgaaaaccaaaagtattttcataacccatttgaaaccaaacctgacctgaacttacactgataggaagctatgggtaattatgatgtgttccttttagtgtgattctttgttgcagaaatgtcaatatattttatgacatggttccctactagggattatacagtatttgctgactacttcctaagagccaaaaataaaaaatctgaattccaaaataatctagtgccaagggcttgggataagaaatgtggacctacaggctgggtgcagtgactcacaccagtaatcccagcactttgggaggctgaggtgggtgaattgcttgaggtcaggagtttgagaccagcctggccaacatggcgaaacctcgtctc

SEQ ID NO: 346887 - DNA, 3798 bp, Homo sapiens
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatac

SEQ ID NO: 346888 - DNA, 1002 bp, Homo sapiens
aatttatcttcaggctggaaaaagaaaaggaaggcctgatgaaaaccgtgtatttggctttgtttacattaatgaagtgattggacagaaaaagtcacaatgacttttttcttttgtgaaaaaaattattgggaatggaattttgaagtcagggagactgaaagaggactcacctatgtctatctggaagatgtatccaaaacacccaggagttttgtgcgcatgtgtatgaaggaagttcagctaggaaaagcttgcagcctgggcaatacagcaagaccccaattctaaaaaattttttttttaattagctgggtgtgatggtgtggcacctgtggtcctagctactcaggaggctgaggtaggaggatcacttgagactgggaggtcaaggccgcagggagaaataatagcatcactgtactctacctcgaccctgcctcgaaaaaaaaataagaaaagaaaaaggaaaaggaaaagaaaaaagttcagatacttcaaaatgtggatttgccataaaaaccttttcttgaagcattcttgaaatttcttaccagatgtcaaacagaaaaagcctcacattactggagaaactttatctaaagccacatacactgggaatatggagatttgtgaatagaaagaggtaaaagctggaagtgattccttagtcagatgaggtgcttccatgaagaagagtaggcatgtcttgaagcaagttatggaggaattggccacctcgccattcctcccacgtcactctgtgaaactccaggtatccttccaggtagtcacctgcctgttttgttcatgatgtgcctgctgacttcaacaaagaaagatttttttttgtgagtgcctttggaaactacaaagctgctgatgttttgcagatggtataaaggttttttgttttgttttgcttgtgtcaaacaaaagtgactcgacagaaaaggttcatttccttgcacagacagtgctgttgcaatgcgtggctatgca

SEQ ID NO: 346889 - DNA, 358 bp, Homo sapiens
tcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatagataaaat

SEQ ID NO: 346890 - DNA, 371 bp, Homo sapiens
aaagggctgatttcctgagtacacattaatctgagctccctcagccctaggggtagggggattgggggcacaagatgggtggagccagatagggaagattcccccagtgttgtcctgctgccagtccaggtttgggaaaatgccggcagcgtttccctgtgtctttcccccacaaagtctccaagtctctcctcaaatgagctccaaggcttgggagaaacaatctcttcctctgcccgggttgcgtggatctccagtggaaaggtgagacagagggatgctgtctgcctctctcacaccctgaggcttcactcacttttatcagtcgaatgctgtcctgagggctgcttgcctgcattgtcctccccagg

SEQ ID NO: 346891 - DNA, 975 bp, Homo sapiens
aaagggctgatttcctgagtacacattaatctgagctccctcagccctaggggtagggggattgggggcacaagatgggtggagccagatagggaagattcccccagtgttgtcctgctgccagtccaggtttgggaaaatgccggcagcgtttccctgtgtctttcccccacaaagtctccaagtctctcctcaaatgagctccaaggcttgggagaaacaatctcttcctctgcccgggttgcgtggatctccagtggaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatagataaaat

SEQ ID NO: 346892 - DNA, 819 bp, Homo sapiens
  misc_feature (58)..(58): n is a, c, g, or t
tagagcgagaaagacatgagagcacaccatgaacacatacggctaggtgcgaggcctnggtggtcggagactggcctcctccgtcgcccgcgctcccacctaccccggcagcctgcctttggtccgcgcttgcgggccaggcttctcaggctcgaggggttggaggaccgttgatcggaaggggcctgctatagagtgaacgggattttgctttttcatcagtttcaggggagggtatgttggagtcggaaaaaaaaaagttttacggggccaccgctcgctttcgtacacgctaagaagcgttttcacttagcacaagcacggatctctgcgcgtcagggcaagctgtgagggagccggtgaagcttatgaccgacaggatgagaggaggacctgaatgaggctacagccgtgcagggaagaattaagtctgtttcttaacaccagggcttcacatgtgccagaagttagaaaatattagggacttgccgtgagtttcgatcttctcagctcaggccctagtagaataaggaaggtgtaaagctggagaagagaaagtgcagaggtgttagggacaaaaactcagccctcgactgtccataaggagagtggcctttcaggtggacacgatcctcatcagtcgggaatgctgctgaaggggagatgcaaatgtagagaacttgaattcctacagatgagcatttcgaacccacaacatgtttatggttagatactagttggcacaacatgaatatacgctttccaaaaggtagaaagtatctcctttacacaatcattcagtaaggcttcattgagcac

SEQ ID NO: 346893 - DNA, 670 bp, Homo sapiens
tgtcttaatttattgtatgtattattgaaaattgagagtactttgagctcagtgtcttaatttcctgtgtggtttgtttaaaatcaagttttgtagctatccccccaatagagtaaaaaaaaaatacccaaaatatctgagaaattttaaatacatgattcatacagtatattttaaagaaatatcttcatggagatgttatccacaatttctttgtgttcaaaggctttttaaaaaatctgactcttaattgtttttgctggcatctttcaaaatttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaaggtaccctctggctgtggcgcttttctccccagagaaatcagtacagagctttgtgccaccaagtactatttaaaaaaaaaattccctaagacttgcaaagtgtcagaacatggaaacataagataaaaatacagttaacgcttgttccttttaaatattgcagttcctacctccattacaatactttctttatcaagactgaggaaaaaaaaa

SEQ ID NO: 346894 - DNA, 2324 bp, Homo sapiens
  misc_feature (2288)..(2288): n is a, c, g, or t
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgatgcggccgggncgtaatttttgtttccagtgagtttccgacgggcgc

SEQ ID NO: 346895 - DNA, 2329 bp, Homo sapiens
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaattcagttgcgcctaacggttcttcttccctactattagttgatgtagaatatgag

SEQ ID NO: 346896 - DNA, 1804 bp, Homo sapiens
cagaaccccttggccgaacccttggccgaaccgatgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346897 - DNA, 1392 bp, Homo sapiens
gatgacaaatcgaacgatcacatcataatccttgaaccaacacattagtcagctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346898 - DNA, 1066 bp, Homo sapiens
  misc_feature (1)..(1): n is a, c, g, or t
  misc_feature (26)..(26): n is a, c, g, or t
nctagcggaactgctctcttaactanccagcgctacagattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346899 - DNA, 2322 bp, Homo sapiens
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaagagtcttgctttgttgcccaggctgctctcaaatgcctggggctcaaatgatcctctcacgtcagcctcctgagtggctgagactacaggcataagccactgtacccagctctttacatgttttgagctgtgagtctccggcatatggagtagtcctgtgtgctgtgctgggggaagtgaccatacgggaagtattctgggaagcctcagcctttacccttcacacaccattagatcctggactctcagagaatattattgttccttgaaaatatacagttagttagttctttgatttcatgagaaaaaagttgagcagactactttgtaattcatttcttatgctgcatctataatacaaacaaataaatacttagacaa

SEQ ID NO: 346900 - DNA, 1991 bp, Homo sapiens
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcaccagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346901 - DNA, 959 bp, Homo sapiens
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346902 - DNA, 474 bp, Homo sapiens
ttcctcaaatatataaagccgggcattttcactaatcctgcatttctgcttattttcaggggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346903 - DNA, 482 bp, Homo sapiens
  misc_feature (56)..(57): n is a, c, g, or t
tagatatttatgttaggtaattagaaagtaagaaagagaataaaaattgaaaaatnntagatttttggggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346904 - DNA, 467 bp, Homo sapiens
gggatactgtgtagaagggacacttgccaaggtcagttacagtcataggctgttgtgttattcctattcagaatcacggaggtggcacggtcctcacaggtttttgcactgaagtagttcttcaaataatacaagttttgatttttaaaaatgaggacgggaataggtagctagagatgtgcgtaggatgtagaattatgcagacactgaatggcataatgaggtcccaggtgattgatatacacattaaagtttgagaaatgctcatctggttgcaagtagagaagaatggacaggaacctgtttgagacaaacacgtgaatactctccgtcctctcatgaagaagaggttgactaatacatatgatcttaaaaagctgtagaatgtgtttgggttgaccactttctactattatgaaacattgattttcagctcttagggatgtagaaattgtagaaaatatatg

SEQ ID NO: 346905 - DNA, 309 bp, Homo sapiens
atatataaagccgggcattttcactaatcctgcatttctgcttattttcaggggacatatttggagaagactgtgtaagtgtaaaggatgactctattcttagcgtcacagtggacgggaaaactgccaaccttaacttggagacacgggtatgtagctgctctttcctacgtttcaagacatttgggaaataaagtgaaggcataaataatctgtgctctcacactcaacagtctactgttgcatattggcatttgcttccagtgtttccaacatttttttcacattgttctttttatattattatgg

SEQ ID NO: 346906 - DNA, 343 bp, Homo sapiens
tgctatctagttgaatgtttgcaatacatgttcagacctttccgttgctgtactttgctgtttaaaaattgactatacaaatgagttactaactttttaattgtgtagctgctttattttagctgtctctataaacaaacgaatggtctctggaagattatcagaaaagtatatacatcttatagttatgtctttctttcaggtgatgtggaagaattagaaattcaagaaaaacctgctctgaaagtgttcaaaaatattactgtaatacaagaaccaggcatggtggtattagaagtaagaaaagatcatttacctaaacaatgaggggaaaaaagtttta

SEQ ID NO: 346907 - DNA, 2426 bp, Homo sapiens
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346908 - DNA, 2636 bp, Homo sapiens
  misc_feature (58)..(58): n is a, c, g, or t
tagagcgagaaagacatgagagcacaccatgaacacatacggctaggtgcgaggcctnggtggtcggagactggcctcctccgtcgcccgcgctcccacctaccccggcagcctgcctttggtccgcgcttgcgggccaggcttctcaggctcgaggggttggaggaccgttgatcggaaggggcctgctatagagtgaacgggattttgctttttcatcagtttcaggggagggtatgttggagtcggaaaaaaaaaagttttacggggccaccgctcgctttcgtacacgctaagaagcgttttcacttagcacaagcacggatctctgcgcgtcagggcaagctgtgagggagccggtgaagcttatgaccgacaggatgagaggaggacctgaatgaggctacagccgtgcagtggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346909 - DNA, 2543 bp, Homo sapiens
  misc_feature (58)..(58): n is a, c, g, or t
tagagcgagaaagacatgagagcacaccatgaacacatacggctaggtgcgaggcctnggtggtcggagactggcctcctccgtcgcccgcgctcccacctaccccggcagcctgcctttggtccgcgcttgcgggccaggcttctcaggctcgaggggttggaggaccgttgatcggaaggggcctgctatagagtgaacgggattttgctttttcatcagtttcaggggagggcttggaagtccttagcatgtcagaaagatgagaatgaagattgagaagttggccaaggagcaaaccctcggaatatcaacatttaaaggtggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346910 - DNA, 1422 bp, Homo sapiens
ttagccttttgttattctttaaaaagaaagaatgctttgtcagctgctggtagctaacatacttttcccattctgttttctctcttagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccaggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346911 - DNA, 2625 bp, Homo sapiens
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatagaggttcataatcctcggaatacagaagcagtgaccttaaacttcagaggagaaaaactagccaaggttatgggatttttagcagacaaaaaaccagaacaaggccagcgggtctcaggaatacttgttaaaagaaactttaattatcacatactttctccttgcgacctgtccaattatactgacctggccatgagcacggtgaagcagacccaagccattccatatactggtccctttaatttgctctgttaccagctgcagaaattgacaggtgatgtggaagaattagaaattcaagaaaaacctgctctgaaagtgttcaaaaatattactgtaatacaagaaccaggcatggtggtattagaatggctggcaaacccttctaatgatatgtatgcagatacagtaacaactgtgatattggaagttcagtcaaatcccaaaataagaaaaggtgcagtacagaaggtttctaaaaaattagaaatgcacgtttacagcaagaggttggagatcatgctccagtaagtttttcacccattatttctcaacaagacagtgacagcggccggaaggagccctggattcggctctgactccttcaaggactggggcgtggctctggccaggccactgccatgctcggaggcctgcttctctgttaggaaagagaggggctggaaccgttccctgccagctctgcactcacctgtgacctgctagggacatatttggagaagactgtgtaagtgtaaaggatgactctattcttagcgtcacagtggacgggaaaactgccaaccttaacttggagacacggactgtagaatgtgaagagggaagtgaagacgatgaatccctccgagaaatggtggagctggctgcacagagactgtacgaggccctgacgccagttcactgagactgtgcctgtatatgaactttgaaaaaatacttgactctacttttgttacctaaaataaaatgcattcgtttctctgggggaaaacaacaataatcaaaacaaaaataacaaaatataaacagacaaaaacacaacaaaaacccaacaacacaacaacaaaaaaaacaacaacaaaacaaccacacaaacaaaataacaacccaaaacactag

SEQ ID NO: 346912 - DNA, 2048 bp, Homo sapiens
  misc_feature (2048)..(2048): n is a, c, g, or t
gaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttccttatattgatttaattgacccagctgagattgatctcctattaattagtcatttccatttggatcactgtggagctctgccctggtttctacagaagacaagtttcaaaggaagaacatttatgactcatgccacaaaagctatttatagatggcttctttctgattatgtcaaagttagtaacatatcagcagacgacatgctgtataccgagacagatttggaagaaagcatggacaaaattgaaactatcaactttcatgaagttaaggaagttgcgggaatcaagtttggtgttaccatgcaggtcacgtcctaggagccgccatgttcatgattgagatcgcaggcgtgaagcttttgtacactggtgatttctcaagacaagaagataggcacttaatggcagctgaaattcctaatattaagcctgatattcttatcattgaatctacttatgggacccatatccatgagaaacgtgaagagcgagaagcaagattctgtaacactgtccacgatattgtaaacagaggaggcaggggtctcattcctgtctttgctcttggaagggctcaggagctgctcttgattctagatgagtactggcagaatcacccagaactacatgacattccaatatactatgcatcatctttggccaagaagtgtatggcagtgtaccagacatatgtaaatgccatgaatgacaaaatccgcaaacagatcaacatcaataatccctttgttttcaaacacattagtaacctcaagagcatggatcattttgatgacattggtcccagtgttgtaatggcctccccaggcatgatgcaaagtggcttatccagagaattatttgaaagctggtgtactgataagaggaatggtgtcattatagcgggatactgtgtagaagggacacttgccaagcacatcatgtctgaacctgaagaaatcactactatgtctggacagaagttaccactgaaaatgtctgttgattacatttctttctcagctcacacggattaccagcaaaccagtgaatttattcgtgctttgaaaccgcctcatgtgattttagtccatggagaacagaatgaaatggccagattgaaagcagcactgattcgagaatatgaagataacgatgaagttcacatacagaagcagtgaccttaaacttcagaggagaaaaactagccaaggttatgggatttttagcagacaaaaaaccagaacaaggaatacttgttaaaagaaactttaattatcacatactttctccttgcgacctgtccaattatactgacctggccatgagcacgcattccatatactggtccctttaatttgctctgttaccagctgcagaaattgacaggtgatgtggaagaattagaaattcaagaaaaacctgtattactgtaatacaagaaccaggcatggtggtattagaatggctggcaaacccttctaatgatatgtatgcagatacagtaacaactgtgatattggaagttgtgcagtacagaaggtttctaaaaaattagaaatgcacgtttacagcaagaggttggagatcatgctccagacatatttggagaagactgtgttttaacgtacaagggacggaaaactgccaactttacttggaaaacggactgaaaatgtgagagggaagtgaaaacatgaatccttcaaaatggggagcttggtgacccaan

SEQ ID NO: 346913 - DNA, 754 bp, Homo sapiens
cttgagaagtggtttgaccagtgttccctcaacacccgggtcaccgtggccaccaaaatcaatgagctggattcagaactggagctgcatctgcacctgcaccagccaagagcccagcagattgaaaaagacatccacaacgtcagggcaggtacagatgctgcctgggaatgtctgccctgcccgcagccactccttcagcgtctgctccaccgcggctccatgttcattagctgccccagtttgtaccatgcaatgtttagcatgttctcatcacaccatggaagatgtacatgagggttcgcacctctgaggcttgcagaaaaaggtagtactccaaatccttctgtgagatttttttctcatttccatttttttttcaagagggtgttatagttgaaaacaaagagtgttgtactgttttagctcttggaacccagatctgctcatacacctgtcagatacacacctgcatggtggatgttctagaggcaagctcatagctcagggagttgaagctctcagtttcaactcctgtgaccgtgtgaccctatacaggttacctgacctctctgactcctctctcacctgcagaaggggttgatagaagtgttaaggaggtggtgataaacccttttaaaatggtatagtaaggaatcatgagcaccttgtacaagatacagcctccaaaagtggtagccattatttctactttatcatttatcatacttaaaaatacatgcatttcacacct

SEQ ID NO: 346914 - DNA, 502 bp, Homo sapiens
gaactctatgttttcctcccatccacagttttagttacatatctgtagatgtttcctctgaaggtctgccagttaggagggcagggtctaaaacttgaggatattttcttacttcttcctctccgtggtatcacttaccccaaaatctctgctgccccatttttaataaggccgtgtcaattacaaacaaggagaaaagaacttctaagccaccactcaaattttgacttattatgaccacaaggactgcaactaacttcaagattcttaaggaaggatattataatttattaagacacttttatcacatatatttctgtgatttctattactgtcaaattctctgaatgcactgcatttgcatttgcagactcaggggagctcactcatttgcttgttctcagcatatttcttctaacgttctctaagtatagccttcccatgggtccatttctttttgtctttaacttgttagataatgccacaatatttcttttttctt

SEQ ID NO: 346915 - DNA, 600 bp, Homo sapiens
gcccactctggactgaattgtaaatcttacccctttctcctcacccaaagcccaacaaagcaatttgaaattccaaacctgtgaccactggacaagatcacctttctcccactgagaagaagatcagcgttggctcgggccaagtctgggagacagacaaggcctcctttcaacatcgtgcctccaggggaaccaggccaagtatcggccctccagagacagctgcagcccttggaggcctccccactgagtccacacccctggcccagggcactcaggctagctgaccggccctgctccctggccagcctcatttcctcctgttctcttgcttggtgcccctagcagccgtcttgcacctggccactgcttcccacgccagggcctttgcctttgctgttcccctgcctggcatggtctcgtcattcagggctcagcctgaatgtcacctcctcctggaagccttaccctcatctcgttatgtcctaccccatcaccctatttctttcccttgggtcaccagtaagaacctgggttgagcttgtgcagccgtctcattgtcttagcctcacgaaactgtaaaccctttgacaaaaggga

SEQ ID NO: 346916 - DNA, 367 bp, Homo sapiens
tttgggaggcccaggcgggcggatcacaaggtcagggataggtttaagtaattgaaaactcaaacttgttagttactaggtggtacctattattttccctaacacatctcaaagaatttctggactagtgatatctgtgaactttgtcaaagtattatgttttagataaatgggagtttagaataatgatgagttctttatattttagttggaaagaattagttagatgcacagtaaaggaaaggatagtggaacaaaaataccacattctgttcctattctcattttcttcccatcattaatgggaataaaatggtttcaaagtaaacaatgaggctgggcacggtggctcatgcatggaatccca

SEQ ID NO: 346917 - DNA, 579 bp, Homo sapiens
aaaactttcaatgccttctcatcagcctcagacaaaaaaaaagatcaaaatccttatctggtacctacctacctcttcacagatgactctgtttactctgaagtacacaagtgtgtaacttgttcaaaatcactctgccttcactcttacctttgagcctgtacacatgctgctctcccctccacagagacactgttttcccttcccccaaatgttctcggttaacatatattcacccttcagatctcaactccaacattacttctatgacacaccaagctaggtggcagcacctgatgtatactttcatgtcacatgtaccttccctagatgtaatttattatagtttgagttatttgattaatggaggaggccaactataaaatcacttgagggtagaaactgtatctgattgacaaaacagtctgacacataatacgtgtaaaaagtcgcagaataactgagtatgtgacaaactaatatactctgtcatactaagaagcacaatacatataattataaatatatttcattttactgtgcattccttttggaactcctgtggttccaacttgggag

SEQ ID NO: 346918 - DNA, 1181 bp, Homo sapiens
aaatatgatcacacttttgaaataacagatggttttcatctcatttgtcaactttgatcgattgacaatggctgcttgaagtgctgcatcaagaagaattctggcacacctgtgaggatggctactatcaaagcagaaaataacaagtgttggtgaggaggtggagaaattgcaacccttgtaactgtacattgctggtggaagtgtgaaatggttgcagcctctgtgggaaatggtataacttcttcaaaaaattaagcattgaattgctatgtgattcagcacttccacttctggatatatacctaaaagaagaaagcagggactcaaacagctatttgtataatgatatggtttggctgtgtccccacccaaatctcatcttgaattaatcttagttcccataatcaccacaggtcgtcagagggacctgccaggaggtaattgactcatgggagcagttacccccatgctgctgttcttatgatagtgagtgagtgctcgtgagatctgatggttttatgaggggcttttcccccttttgcttggcacctctccttcctgccatcatgtgaagaaggatgtgtttgcttccccttctgccaagattgtaagtttcctgaggcctccccagacatgtggaactgtaagtcaattaaacttctttcctttataaattacccactctcgggcagtcctttatagaagcatgagaacggactaatacatatattcatgttcatagcatatattcatagtagccaaaaggtggaaacaacccaagtgtccggcaatggatgaatggataaaaaggaaattctgacacatgctgcaacacagatgaaccttgaagacattcagagacataagccagtcacaaaaaagcaaatactgtatgattccatttctatgaagtatctagcgtagtcaaatttatagagacagaaagtggaactttggttgacagaggctgggggaaaagaggaaatggagaattagtgtttaataggtttcagctggggaagatgaaaacattctggagctggctggtggtgatcattgcttaacaatgtaatgtacttaatgccatagtattgtacactaaaaatggttaaaataaattttatgtcatgtatattttaccacaataaaaacaataaaggcttttgagtgactgcagg

SEQ ID NO: 346919 - DNA, 285 bp, Homo sapiens
cctgcattgtccgtttcctgagtttccttttgtccgtttctctctcgtttgttcattttaaagagataggcacaaaaaagtcaataaatggcgatgccatctgtttgctgtaaaaacaatatgaatgtatcacttttttttttttttttttagctcagatgctaatgtgtctattttttggttagttgtgtgtcagctactttcccgttaaggtttacagtcaagaaaagacccattggtcttctggtttggggcttaagttgtgctgcagcatgttctttcttg

SEQ ID NO: 346920 - DNA, 570 bp, Homo sapiens
aaattaaatatattttctttgtcttattttcatgtcaacctgtaaaagcctgctgcccataatgcagcagcggaggtctctgaacctcttttagttctgagtgctgcctagtttatgaatcgctccttgctcaaataaatttaattttgcctaaagttttttttcttttctttttcttttttttttaaaaaacagtttctgtgctcaaatttttgcccttcctaaggacaccagtcttatcagaggcctaccctatcccagtatgatcttattctaatttaagtaattttatctgcagtgaccctatttgcaaactaaggtcacattctgagatactgggtttaagacttcattccatgaatttttggggggacacaattcaacccataacaatgggtaaaatgaaaggattgttaaaataatttaggcaaaaaaaccccacttacccacatttgcttgataaatccaagtcagtaggacaaaaattgattatatgagacactttcatttttgtttaagtttgaataccatttaaatcagaactttaaagcctgaaatcaagctctgctg

SEQ ID NO: 346921 - DNA, 1467 bp, Homo sapiens
aaaaagaaagaggcagtaattcctcttgtgggcaaggttctgcagaatgatttggctcctgcaggttaagtgcccagtcataggtgtgggatagagcagactcctacggatgccagtggagacgttgtgggcctgggtctgctgcccactccccagtgggtcaggactccggcagggtctcctgggctaaagcatggaggtgactgtgtcccaaggcactggcagctctgcccagcctgttcctttcccaccctctggccctcagcgactttggctgcatgtgcctctggcagggcagaaccagaagtgggggcctagtggccttccaatttggggttcttggagaaggagcctggcgtgccctccttggggagcaggtggacagactggatgttttatggagtctgggggagtcctgcggcagctatatctgttaaatgccaagaagccaagttggtttaatatgattgtagctgctgctttgataaatcaaaataattaaaaataataaatttgattcctcaaccaacaggctgtgtgtgggcgcagggcctgggctgccgagtcagggccgaggaggtgggagtgggcacggggacacaggaaggcctgtcttgtgggatcctaaatggggagtggacggcaacagggcggaaggggagactgcgaaccagtcgggggaggaacatctctcacttagcagagccgagccctgctgtccacaagcctgggctggggccccagctgggcctgcccctggccctgtggcattgggccagcctcagtttcctcatctgtcaaatgggaaggcagttccacccacctcccagggatgtgtgaagtcaggctttgctgagtgtgtctgcccagtgttgaatgggcctccgtagccccctcggcccgtccctgcacccgctttggtcgctgaggcgaccaggcgtgctcgcagcggctgcacagccttaaaggcccaccagcctgcccggactcttcctcccactgatggctgttgtcctaccacaggattgttctgtttatgaggacgtcctccggtgcaggacgtctctattcatagctcccttcggcttccagagttgggtcaggaagccccatgccacgccctgggaccgagttcagggtgccggcagctctgacatcagttgggggggaattggcaagggttttctacctccgcccctgtcccctgccccctgccccccatccatgtcctcaggagccgtatttggtgtctgatcccaaagtgtctgagcagctggaaatctgaactggttggagggggcaggggctggtgaggagggagggacagggtgtctgtctctttaaatgcactttgtgtcagtgcgataaggaatttgatggctttatcagaaataccaaagctttatttagcagggtgaggctcacaccactcagctccacacaacctgctgataaatagcaaaaaag

SEQ ID NO: 346922 - DNA, 1214 bp, Homo sapiens
aattttacggaatttaattaaaatcccgtgcctttctcacccactaccctccccccattcatatatcatatgaaaatgaaaattataattcttcttggattcctgggagccacattgtcagcaccacttatcccacagcgtcttatgtctgccagcaatagcaatgagttacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagacaccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatc

SEQ ID NO: 346923 - DNA, 1044 bp, Homo sapiens
aattttacggaatttaattaaaatcccgtgcctttctcacccactaccctccccccattcatatatcatatgaaaatgaaaattataattcttcttggattcctgggagccacattgtcagcaccacttatcccacagcgtcttatgtctgccagcaatagcaatgagttacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacatattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctagatttga

SEQ ID NO: 346924 - DNA, 1172 bp, Homo sapiens
aattttacggaatttaattaaaatcccgtgcctttctcacccactaccctccccccattcatatatcatatgaaaatgaaaattataattcttcttggattcctgggagccacattgtcagcaccattacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagacaccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatc

SEQ ID NO: 346925 - DNA, 1304 bp, Homo sapiens
aattttacggaatttaattaaaatcccgtgcctttctcacccactaccctccccccattcatatatcatatgaaaatgaaaattataattcttcttggattcctgggagccacattgtcagcaccattacttcttaatcttaataatggtcaacttttgccactacaacttcagggcccacttaattcatggattccacctttctctggaattttacaacagcagcagcaggctcaaattccaggactctcccagttctctttatcagctctagaccagtttgctggactgctcccaaatcagatacccttaacaggagaggccagttttgcccaaggagcccaggcaggccaagttgatcccttacagcttcaaacaccgcctcagacacaaccaggccccagtcacgtgatgccctatgtattctccttcaaaatgcctcaagagcaaggacagatgtttcaatactatccagtttacatggtcctaccctgggaacaacctcagcaaacagttccaaggtcacctcaacaaacaagacagcaacagtatgaggagcagataccattctatgctcaatttggatacattccacaactagcagaacctgctatatcaggaggacagcagcaactagcttttgatccccaactaggcacagctcctgaaattgctgtgatgtcaacaggagaagagacaccatatttacaaaaagaagcgatcaactttagacatgacagtgcaggagttttcatgccctcaacttcaccaaaacccagcacaaccaatgttttcacttctgctgtagaccaaactattaccccagagctcccagaagagaaggacaagactgacagcctaagggaaccataagaagttgccctgatcattcagacattttgggaaaaagatgtggccatgccttggatataattttaggctattagcttcctcaatactagtatcagttctttggaatacatgaaatatcttgactcttctcctaaatttgtttttacttatacatgttattaaactctttaaatatgtcatagaaaataatacaatcatgtaatgagtcttgtcttacaaaattatatgtctcttcaaatatcctatcattgtataatatggaatataataacacagaataaagctagtatcattaaatcaattggataattgcattagtaaatgatgcctctgcaaaatggtagtacccatgaagatatgtatattgtcattggatgtatgatgagtgttgtgattggaactgatgaagtaaaataagtatctagatttga

SEQ ID NO: 346926 - DNA, 699 bp, Homo sapiens
ggagaagggaaaaggaactttgagcccttgtggccagttcacaacaaaagtctgttacgccatggtttgtagcctgttattcagcaggaaaaaatcttggaaaaacaagcatcttgttctgggaatgtcagggagaaggaaaacaattcaaaatccaatcagtgtctttgagcgaaacacagattcttttattctgctagtttggacaacagttcctcatgcagattttacagagctagaggttgtcggaatcatgagaaagtctaggaaaagcctgaatcacacaagcttataagatttggggccgctgcaggattgtggagcttcaccaagggagaggatgggagggcggagtgatatatgaaatggaaaactgcattctggcaaaggatgtgcctgctctgaaattctcatagcaggatgacacttgaaacctttgtttctacttttccttaaagtgcatgaggccacacaattgttccagtcactcttactgtataaaaatcattccacaacttagaggtataaactacaattcatctattttgttcccagttttgagggtcaggaactgggtgaggcagtgctgagcagctctcattcgcagtctctcatgcagttacattcagatgtccactgaggctgcagtaatctaaaggcttgccaggctagatgtccaaggtggagcaaatcatatag

SEQ ID NO: 346927 - DNA, 433 bp, Homo sapiens
gaaagggaaagcctaaagaggaagacacatgaaagaacaaagtaatgttttccaagtagtcccttgaggggtaaacatgagctgttgtggaaagaaacaggacttctcggggagaaaaaacctgggttgaattctgattccaccattttgttgtcctgtatccttgagaaagtatgtaatcccttttcacttttgtctccatttcaatatagaacactaatgaaaacaactttttttgatcagatccagtactctcttttgtaaaatgattcagtacctctaagttactgtgcaagtataaggtcttataatcattattttgataatagctaccaagaataaggaaagaaaatctacatagccaagtcactagaaaggctgcatttgccaaggtcatacttagaacactgggaaatgttcatatgtgacatct

SEQ ID NO: 346928 - DNA, 881 bp, Homo sapiens
tgtgtgtatcatatatacatctgcacatataaactgtgtgtatcatatataatacatctgcacttataaactgtatcatatatatctgcacatataaactgtatcatatataatatatctgcacatataaactatcatatataatacatctgcacatataaactgtatcatatataactgcacatataaactgtcatatatatctgcacatataaactgtcatatatatgcacatataaactatcatatataatacatctgcacatataaactgtgtatcatatataatacatctgcacatataaactatcatatataatacatctgcacatataaactgtatcatatataatacatctgcacatataaactgtgtatcatatataatacatctgcacttataaactgtgtcatatatctgcacatataaactatcatataatacatctgcatatataaactatcatatatacatctgcacatataaactatatcatatatctgcacatataaactgtgtgtgtatcatatataatctgcacatataaattgtgtataatacatctgcacatataaactgtatcatatataatacatctgcacatataaactatcatatctgcacatataaactatcatatctgcacatataaactatcatatatctgcacatataaactgtatcatatataatacatctgcacatataaactgtatcataatacatctgcacatataaactgtcatgtatatctgcacatataaactgtatcatatatatttgcacatataaactgtgtgtatcatataatacatctgcacatataaactatcatatataatacatctgcacatagaaactgtgtatcatatatctgcac

SEQ ID NO: 346929 - DNA, 407 bp, Homo sapiens
tagggcttgggattagccattgccatagaatggagtgaataacagagaagagaaactgtgactaatttaagagtgataatcatacaattgcaatttggagaagattgacctgaaagaactgcagaggaagcatgctctttgtgtaagaaatccttaaattccacacaaaatctatatagtcttcctggacatgatgcataaggaaatcctaagactgcatgccgagtttaaccaattaaactggaataaactggaatgaatttgcatttgggaagtaaaacactatccaaggggcataagaacagctgggctcctactgaaggagacacatatggtgttcattgtggggttttgcttcttattccctttgagtaagaataaaatgatcttattttttgctcttcaaa

SEQ ID NO: 346930 - DNA, 419 bp, Homo sapiens
attcaatttcacattattccaaggcacataacagacttggatacaatcatgaaacgttcacacctgaaaaataatctctgtagaacttgttttcaatgattttcaggtcagagacccctttgaaaatctgcaaaactatggaagtttatttcagaaaacaaaacaaaaaaaaaaaaaaaaaaccttaacattttagggatttcaggttctaaagaagatttttatagcaaatgtcacaggcgtttgaatgacagtaactccattttgaataggggctggataaaacgaggctaagatctgctgggttgcattcccaggaagttaggcattcttagccacagtatgagataggaggttggcacaagatacaggtcgcaaagaccgtgctgataaaacaggatgtgataaagaagccagcc

SEQ ID NO: 346931 - DNA, 199 bp, Homo sapiens
ggggtggagtgtagacagagaagcatgatttgtagcttttatacagtgcaatcagggaagaaaggcactgcatcggaagggtgctaaaagccaaagtctatgtgtgttccatagtaagctggggataggttagtctggcggaaagagctctaggacatttgattcaatttcaatatctcctgttcaccaagtaattacc

SEQ ID NO: 346932 - DNA, 313 bp, Homo sapiens
tggcctcagtgctagaaatctgtattacctgagcaaatgtttaggaattctctttgcttttgaatacgttgaaagaaaggaattctttctccaatttgttcagctctcctcctagttaaaaagaaactaccatatttgaccccaagaaagagttaaatgtgaactcatctgagttttcagaaaaggaaaggttgaaagctcacacattaattattactgctgctattctcttccgccccccagaatttgtcagtggaattttggtccctaaatgtataggcatgtttgggttagggtaggacataccccacct

SEQ ID NO: 346933 - DNA, 577 bp, Homo sapiens
acatccttgccatggcatggaagcttggtggaagctggtgtctttccccagatcccctgtcgcctgttaggtgagcatccctgtcctgcactgggcttagtgtccccacgggttaagctgcgctgtcctgcacgggggcgtcaggaggagtctctttatcagtgaggatgagaaaagagacctgggatccgaggtgcggcagagggaatgtagctaacagtttgtgataaaagactcaaacccatgcaccttttttctcttgctgacccccttccgttcccactgcgttcctccttccttgccttccccctcccctgtctcttgggctccgctgggcctcgctctgctccaggtgtccctgtgctgtctccctctgaggatgctcagtggagcagggaacactggaggctgtgttagctgtcagcccttctgtgtccatcttccaaaactacgtgcccttcggtgggaggttttatcatctttagaagtcagtgatggtgcagttcatgttgcttgggggtgtggagataacacatgagtagccgaccatgtttacctggaagttctgagaattaaa

SEQ ID NO: 346934 - DNA, 197 bp, Homo sapiens
tgtactctccttgaaaaacacacattccaggtgaacgtaaccatctgccgtcttaatgctccctcccaggtacttgagtgtaactggagaaaattgtacaacctggcatactgttttcacttcatgaccttatatgtcaaatggggtctcaatactaaccagaaattctctttctcaattaagctcacttcctgata

SEQ ID NO: 346935 - DNA, 527 bp, Homo sapiens
tatgtacaaaaacattttaattgaaatacctgtataaaaaaatatgatctccagacatctcacttttgaactgaaagaacccccatctgcgatgcctgcacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggagg

SEQ ID NO: 346936 - DNA, 2067 bp, Homo sapiens
tgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgaaagcgcaagaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggagg

SEQ ID NO: 346937 - DNA, 2427 bp, Homo sapiens
tgggagccgctgctggtcccggccttgcggcctgcgggggaggctgcccggaggaggcagcggcggcggcagcgcgtcctcggtccccaggaccacggcttctttcctgccagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgaaagcgcaagaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggagg

SEQ ID NO: 346938 - DNA, 1507 bp, Homo sapiens
tgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgaaagcgcaagaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttccc

SEQ ID NO: 346939 - DNA, 388 bp, Homo sapiens
cccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggtt

SEQ ID NO: 346940 - DNA, 2111 bp, Homo sapiens
  misc_feature (54)..(54): n is a, c, g, or t
aaaaaaacttacgggcgtctaagaggtaagcgaaggcccctcggggggtggtgnaagaaatcggccgagggtccggcttgtgagaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgaaagcgcaagaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggagg

SEQ ID NO: 346941 - DNA, 2100 bp, Homo sapiens
tgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgaaagcgcaagcaagaaacgcaaagccaggggcaccatggtaagaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggagg

SEQ ID NO: 346942 - DNA, 570 bp, Homo sapiens
  misc_feature (54)..(54): n is a, c, g, or t
  misc_feature (473)..(473): n is a, c, g, or t
  misc_feature (548)..(548): n is a, c, g, or t
aaaaaaacttacgggcgtctaagaggtaagcgaaggcccctcggggggtggtgnaagaaatcggccgagggtccggcttgtgagaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgctgcacatggtttgggtcgtgctgctcagcctcctgtgctacctcgtgctgttcctctgccgacattcctcccatcgaggcgtcttcctatccgtcaccatcctcatctacctactcatggggtgagatgcacatggtagacnacccgtgacatgcgcacaagcatgcgcaggggcacagactgattcgtggccatgacaggcagctgtcgtctggcngcttcgaccctggaccgggcgc

SEQ ID NO: 346943 - DNA, 216 bp, Homo sapiens
aaatggggcttccatttagagttaaaaaaaaaaacaaaagcaaaacaacaaaaaaaactcctttcataatagaaaaacctagctagtaaaataatttgcagtaatgagatctgtcttaaattttggtttgttcatttatttaattttatttaatgatttactcacataagtaaataaaaatgattttttgttgaatatatgtaaatcccaagttta

SEQ ID NO: 346944 - DNA, 657 bp, Homo sapiens
aaaaatcttataaatgtgaccagtatggaaagaactttagtcagagccaagatcttatcgttcattgtaaaactcactctggcgagactccctatgaattccacgaatggcctatgggctgcaaacagagctcagaccttcccagatatcagaaagtcccttcaggaaacaaaccctacaaatgtaaagaatgtggcaagggcttcaggtgcaactccttcctttataaccatcatggagtccacacaagggagatgccctacaaatgtgatgcatgtgggaaagggtttggatttaggtcacttctttgtattcatcagggagtacacacagggaaaagccctataaaagtgaagagtgtgggaagggctttgatcagagctccaaccttcttgtccatcagagagtccacgctggagagaagccctacaaatgcagtgagtgtggcaagtgctttagttcaagctccgttcttcaagtccactggaggtttcacacaggggagaaaccttataggtgtgatgagtgtggaaagggcttcagccaaagtacacaccttcacattcaccagagagtccacacaggggagaaaccatacaaatgcaatgtgtgtggaaaggattttgcgtatagctctgttcttcacactcatctgag

SEQ ID NO: 346945 - DNA, 430 bp, Homo sapiens
tacacttcacagagtgggagcaggctcaagcaagtggctcaagagtgctggttagagaattttctggggtttaaataccctctagaggtttcccattggttacttggtttacaccctatttaaatgaggtagtggtctgcagccagtctgattagttgctgggtgaccaatcagaggctgaagtgaagttacagagttacaccctatgcaaacatctgattggttgtggaaggtgaagtgaagttacaaagttgtaaccctgcgcaaagactaggcttgtgaccagtctgattggttgcaggaggggaccaagcagagactgaagtgaagttacaaagttatatccttatgcaagtgaagactaggccagtgaccagtctgattggttgcagtgggggaccaatctgaggaactttccatttttcacctg

SEQ ID NO: 346946 - DNA, 338 bp, Homo sapiens
tgacacagtgaagctctgtcaaaaaaaaaaaaaaaaaattgacatgaggcaattcatgaaagcagaaacgtaattgcttaatctgaaaaaatgtccaacctcattagcaaccaaacggccactttaaaaaatgcatatatgtgcatacacacatgtagaagtgtatatatgcacacacatatacatatatttacacactttttataaaaatatatacatttatgaaggtatgctaaacatattgaaaggatgcagttttagtctacagccataccaccttgaatgtaccccatcttgtctgaaaagatgcagttttgccttccaaatttgcagacttt

SEQ ID NO: 346947 - DNA, 2437 bp, Homo sapiens
agggaatgtagggagggaggtggaagcactaggaggaggggaggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgatgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctaaatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttga

SEQ ID NO: 346948 - DNA, 2391 bp, Homo sapiens
agggaatgtagggagggaggtggaagcactaggaggaggggaggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgatgcttgccccatctatttatgtctccgctttgtaccataaccgaacccacggaaagacgctgcgcgggtgcagaagaagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctaaatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttga

SEQ ID NO: 346949 - DNA, 2690 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346950 - DNA, 3042 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtgaaaaaaaaaaaaaaaaaaaaaaaaaaaaaaaaaaaaaaaaaaaggaggaaaaaaaaaaaaaaaaacaaaagaggagagaaaaatgcaacaaaagaaaaacacacccacatgacagcatcaaccacacaaaggggcggccccaaccacaagcaaggcattcccaatcaaaacaatccaaagcacggggaatgccacgaaccaaataccccgagaacgcagagaaaaaaaccacaaaccaccaagtatagtcaatagaaaaaaaacacacaaggagcagaaccaacaaacggacaccacagagacacccaaaaacaacgcacaggaaaacacgagaaggaacgatcaaaaaaaaa

SEQ ID NO: 346951 - DNA, 3017 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtgaaacaaaaacaccacaaacacaacaacaaaaaacaaaacaaaagaaacaaataccacactaaaaaaaacagcaaacaaaaaagacagaagaacacagatgccaaacgcgaacaaccaggagagagacaggagagagatgaagaaagagtaataggcgagctagtgcagtcgaagggagagacgagccgagaggagcacgaagaagcgagaagaagtagaaaggaaagaggagcgcaggcgagaggagaagggagtcaaatagataaggagagagaggggagaacagagacaagcacgggagaggaaacggagataggaaataaagaag

SEQ ID NO: 346952 - DNA, 2430 bp, Homo sapiens
atgtactgttccatctggaagtcaagattggtgccacctaagtgggttcctgctgcaaggaacttaaggacatcctcctccttcatttgcaggacatcaagggctccggacattgtgaaagtttccctttaagttacgacgggaatccagaacaacgccgtatgggcccctctctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346953 - DNA, 2538 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacaggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346954 - DNA, 1577 bp, Homo sapiens
caggacagctgtcgtgagtgttccatgctcgtttccttctggatacatcagcaactcactctgctatgatcctgcaatacatctcatgttagaattagagacatctggagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346955 - DNA, 540 bp, Homo sapiens
  misc_feature (37)..(37): n is a, c, g, or t
cggtggggatttatggctggcggaaacgatgcctgtntttctttgtcctgctcctcatgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346956 - DNA, 1700 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccatgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 346957 - DNA, 2636 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagttttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346958 - DNA, 2636 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtga

SEQ ID NO: 346959 - DNA, 1652 bp, Homo sapiens
agcgggttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgagcacatccctaccctgtaggtccatcgggggcagagtcgttggagtttgaataggaagaggaggaggagaaggggagtgagcggccgct

SEQ ID NO: 346960 - DNA, 2019 bp, Homo sapiens
ccccagatatgtgagttacatgagatggcacagtgataaagccccatttagtgaccttgcctccttctccttgccaactttgaaagtgcctccgtgtccagactttgaacttgcctgccagccttcagcatcaggaaaggccaagtcctgggtgtgagtgttcctgtgtaacaagaactgggctcaacggtccagctgtttctatggagctttggggttccttgagatgaatgaacatatcattttatcatccaaaggatctcactggactgttcaacttccagccaaattcaaggagcttgcgggaacatttgatataacaaatgtgttgtcattgttggcaacatacaagataaccaagaagctggagtctgttctgtgttgatttgactaccatgagaaacacaggggaaacctgatgaggagaaggataagactgcgtaaggagaaatcctcataggagctataaagcaggctgctgatctcagcagttgatatggtggttgtgcctctgctggctactgggtgtgctgtccccatgttcccgctgtgatttggcagaaacacaataggcttctccttgtgtgatctcagcttcaagcaggtgaaactgctgtgcagagggagttgccccttcccagtaaaagagttgcagcctgttaaacaatgtggtctaatttagtgtctctcccttggcaaatgtaagttttctaagttggccaacttgtctcttacagccagtggctgtggtctacagaattgtttcatataaaatacgggtagagtggtagagtttcaaaactttcgtcatagatatctgggacctttctcaggatctgtgttcacacagccaatagatttggaatcaggcctaagagtacacatggagggtaaatattaaagtgcgtattatgtacatctagaatccatgtgacttgcagcctacctgtaatttctatccattgagcatgcatggatatacccaatagtacacacaaaataaatgtttacttaagagccattctatccttttgtgactgaaatggtttattgtaaatctgcctaaagattttttgcatattatatatgtgaattttggttgtaagttcataacttacccaagggtatagactcataactcttttaaaacagtgcttagtacaatatcctgccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatatattttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattata

SEQ ID NO: 346961 - DNA, 296 bp, Homo sapiens
gcatgagccacctcacccggctgaatttatggatttaaaggaggtcactgcattgtaaatcaagtgttgagtgacagtggtacgcataacagtgaacctcctcatctaagctctatatcaggggtcagcaaattatggcccctggtttgctgaccctttacagtttcctatagcctgcaaactaggaatactatttacatctttaaagggctttagaaaagtaaaactaatattttgtgacacatcaaaattatatgaaatttgcattttagtgtccattaataaaattttcttgg

SEQ ID NO: 346962 - DNA, 585 bp, Homo sapiens
gcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagattta

SEQ ID NO: 346963 - DNA, 607 bp, Homo sapiens
tgtagggtccaccactgatcgcctaaaatctgaacgtgtatgcggccggggaggcaggcaatggagggaggcgacagaccagggcgtcaaggctggtccacttttgtctcgggccggctggtacctggagctgagcaccttgacacagcgagacctccccctggacgtctctccatctcctgcctggtctgcgcgctgcacctgccacagttacaacttgggcaaatgtgcagtcaccgcgtcgttaggtgaatgacactcactcttcttctcgggggttctcacgccttgactctctggcgtcatcgccctggctgctgagtcctcgcaggtggccactggccaccctccctgtctgcatccccactccggctctcacagctggtatcacctagggtgagtcatcagctgtacctcagtctccccatccaaagggcttgctgggatccgtgtcctgacctggctgtactggggaacgggtggctgttctccatcttgtcccaggccattgccccctctcctgcatttgtggcccttcctccaacgccccctcctctccgtgacagcaaggctctggggaaggtcagcctgggtgggcctgtctcca

SEQ ID NO: 346964 - DNA, 356 bp, Homo sapiens
gaaatatatatacatatatatattccaacctgatatatatatatatatcaggttctttattattttgttcctcttccatcctggctatatctgccagatagaagaagaagtctaccattaaccaggacaccaggcagtcattaaaacactgtgccaccatctgctccacccagtttttttttttttttttttttttttttttgagacagggtcttgctttgttgcctaggctgttgtgcagtggcatgatcttggctcactgcagccttgacctcctgggctcaacagatcctcccacctcagcctcccaagtagctgggactacaggcgcatgtcaccttgtctggctaattttt

SEQ ID NO: 346965 - DNA, 590 bp, Homo sapiens
caagaccctatctctgcaaaaaaaagaaaaaaaaaatagttgggcctggtggcacatgcctttggtttcagtgccttgggaagctgaggtaggaggattgcttgagcccaagagtttgaggctgtagtgagctgtgatcatacactccagcctgggcaacacagcaataccctgtcgtttaaagaaattaaaaagaaaaaatacaaaaactcctaagaaaaagttaaatcacttcatatatgttattttctccaaattattgagaggtagaatttttatccctgtttgttggctaaaacagaccaaaatacaggaagtaacttatctagtgccttttctcaccagaattctcacctccagccagagtcttgtgtttttaccctgaaccaagccacctctgaaagaaagttaaacaggctttgagaagatatttttccttggattttagatccttgtagcatttctgaaaagagagttaactctgcatatgaacattcagaagcttttggagaccttcaaggtcatcagcacctgacactgggagaaagggtgggttagggttggttctgtccaatctacacaatatctaa

SEQ ID NO: 346966 - DNA, 303 bp, Homo sapiens
cggggtttcactgtgttagccaggatggtctcgatctcctgacctcatgatctgcccaccttggcctcccaaagtgctaggattacaggcgtgagccaccgcgcccagcctatgtgatgcaattctgatgtcaactccctgatgttacctcaaatgccacaggttaaggccaccagcccccactaggctgccctcgctttagacacacctgcaggcttgggtgtcctcagaccacatgtacttctcaccaactggctgcaaatttggaggttcccaccatgccctcaagttcgataactcact

SEQ ID NO: 346967 - DNA, 516 bp, Homo sapiens
cagctgtttgggaagaggctgtgattcggccttgtttgagggccgatactctgaatgggtgaggcttggaatcctccctttggaacaaagaaacataatgattttgctgaaggtagaattgggggactaggcagagtggcctcctgccctccctggggtggttctgtcttttgcaaaggtggctgcatccttaggggaaggtgaggggagaagcagggagcatggagagaagtggctttcgattttctctctccttttggggagttcctccttatgtggctggtctggtgcatagtgtgatgtattcctgtacgcaacgttgccctgacagccagtccaagctgagtctagagctggcaaggtgagctcccagtagtaagagggtgtgggcggcaagccacccaggcaccgaggcaagagacagaggacacgagctgttccagtataataaaatataaaacaagaatagttataccagatatagatcttagatatgattatatatgaatatcatta

SEQ ID NO: 346968 - DNA, 383 bp, Homo sapiens
cctgtgtgtacatagggaaaatctgacaagacaggctctaaactattaacaaggatttcctttaatgggtgggattctttctttacacattctcacattatttgaatacatttctatcagcaagtattagttttatcattttaaacaaaagataaaaataggaagaaatactttttaaatgaacaagtagctggcattacaatcaagtcattggcgtatgagatttataaaggcctggccttagaccagccttctctaattaatcattcccctgtctcccaccactgatcagagacttttccctgatatgtcttattctcctgtccatctgctttcaagcatggatactcctggatgagctcttctttctatgattactgcac

SEQ ID NO: 346969 - DNA, 322 bp, Homo sapiens
ttggggtcttgctctgttgcccaggttggagtgtataggtgcaatcatagatcactgcagcctcaaactcctggcctcaaacaatcctccctcctcagcctcctaagtagctggtgttacaagcatgagccacagcattttctacctgtgaaatgagacagaatctcactctattgctccggttgaagtgcagtggctgcttacaggggcgatcacggtgcactgcagcctcgaagtcatggcctcaatcagtccccctgcctccactcatggatctgccttaaaaatcgcctattaaaaatctaatcattcagagtcgaaa

SEQ ID NO: 346970 - DNA, 344 bp, Homo sapiens
aggttccatcaaagtgataaacttcaacccctccaggccccgggaatggctgggtataatactgcaaatgagacataggaagtatacaggaagttctcttcaaacttcggactccgagcagtggctgggcttccagagtcaagctctagcagagcactccccaccaacaatctctagagacagaatctcactctattgctccggttgaagtgcagtggctgcttacaggggcgatcacggtgcactgcagcctcgaagtcatggcctcaatcagtccccctgcctccactcatggatctgccttaaaaatcgcctattaaaaatctaatcattcagagtcgaaa

SEQ ID NO: 346971 - DNA, 2479 bp, Homo sapiens
gactcaccctgggccgggggtgaggcttggactgtttctttttccaaaagaggagctcaaaagagaaagttcatctagaaatctcaaagccatgtctcaggatgaactagagtatgcccttacagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtattacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgaga

SEQ ID NO: 346972 - DNA, 479 bp, Homo sapiens
tatgtttagcatgagattataagtaaatacaaatggatgtattttcagagagaattttatgcaatataaaacataaataaggaaactagtctgaccagtaaacattgtcagtactaggtctccaatatctagttctcacacatttccgatcacttcaggatgaactagagtatgcccttacagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctaggtgagtctataaatgaagtctagtgaacattaaatgtcaagtagttgaagcctttgaatgtttttagggatctatt

SEQ ID NO: 346973 - DNA, 408 bp, Homo sapiens
tttgtattttccccagatctctttcagtttattataatgctggagcaataattaaatgttccttagcgtttcctatgtcctacacctcactgaaaacatgtcggcagagaaagcaaatgttcatcatttctcaatataaaacagatcctgccagggatcatgccaaacctgaccaaccatgacagtcaaatcaatgtatgttttggtttaaatttttatttttgcctttgctttagcaacttgattctggtatttgtttttccctgtggcttatcattttatggcatgacagttcctgaaattgacaaggcttcctgcttacctttgtaatgcatatgtgtgacaatataaactataagagaaaatgacattttgactcaataaatatttgctttatgtccattacat

SEQ ID NO: 346974 - DNA, 647 bp, Homo sapiens
ggcaaagacaacaagcattgatggcaataagtgtactgatggccccgcggttggctgttaatttcaaggcgggttgaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttggcgtgtctctacaaaaaggtgcatataccactgaagctgctttgtttgcttttgtgtgtcggattgaacttttctttcatgaatcacggttaggaaaggcttctcttgttttctgctaataaaaagacagcttgggccaggcgtggtggctcacactgtaatcccagcactttgggaggccgaggcaggcggatcacctgaggccaggagttcgagaccagcctgaccaacgtggggaaaccctgtttccactaaaaatacaaaattagctggcatggtggcatgcacctgtaatcccagctatttgggaaactgaggcaggagaatcacttgagcccaggaggcagagggtcactgagccgagatcatcccattgcactccagcctggactaaaagagtgaaactatgtctcaaagg

SEQ ID NO: 346975 - DNA, 2680 bp, Homo sapiens
ggcaaagacaacaagcattgatggcaataagtgtactgatggccccgcggttggctgttaatttcaaggcgggttgaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttggcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgctttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggctgcgggaagagaatgacttgggccctgcaggcatggtggacagcagccagggccaggggtatctagaggagaaagcagccccctgctgcccggcgcacctggccttcgtctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtggcctcgtgggtgcttttcagcggctgcctcagctacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagcagggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgcttttaaaaaaaaaaat

SEQ ID NO: 346976 - DNA, 533 bp, Homo sapiens
aggccaaggtgggaggatcacttgagcccaggagtttgggatgagaccagcctgggcaacatagggagaccctgtctctacaaaataaaaaaattagccaggcatggtggtcccagttacttcgggggttgaactgggaggatcgcctgagtctgggaggttgaggctgtagtgagctatgtattactgtacttcagcccccgcaacagaacaagaccctggaccctgtctcaaaaaacaaacaaacaaacaaaaagttcaatggtgaaatgttagaagctttcaatttctgattaggaatcagacagggatgcccagaatcattatttccactcatcattgttctgcaggtcctagctggtgcattaaaacaagaaataagagatacaagaatcagaagaggagaaaccaaactgtcattgttttcagatgatatggttgtacctataaaacaccaaaacttttatagacaaattaagaattaataagctagcttaccaacttgctcaatcaataaacaaaaattcaattgc

SEQ ID NO: 346977 - DNA, 2213 bp, Homo sapiens
ttgcagcctctcttccgcccggcggccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346978 - DNA, 2090 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346979 - DNA, 312 bp, Homo sapiens
gaggaagacagagagaaaggaggatgtaaagtagagaattaaaaagaacagagcggagaggggagaaagaatgagaaatcgggaggcgaaggagagagagaaggggagagggagagagaaggaatggagagagcgaagaccggaagaaggaggcccgagcgaagggaagaccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346980 - DNA, 2041 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346981 - DNA, 2197 bp, Homo sapiens
ctgcagcgagagcgcgcggatctcagcgcgggagcagtgcttctgcggcaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346982 - DNA, 2005 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaagtttcagtctccaactctcagcccaccaatgaaagccactctatcaaagccatcctgaaaaatggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346983 - DNA, 2467 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtgggtaagtggaggaagagggccccaggcccctgtgggaagtaagagtccagcctggacccagagagggaacccaagaaagtatggtagtaaggggaccatttgttttaaagtcgaggcataatttatgtatagttaagtacaagtcttaagtgtacaacttaatgaatatatgtatatacacatacctgcccagatcgagatgtagaatatttccagcactccagaaggctccaccatgcccctttcaagagtaaccccctaaggagaaccaggctttgaggtttcagttcagatcctgaggggccccagatggatccttgggggcctggctgtgccctggggtggcggcctgggctgaggcctgcctggtgcccacagcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346984 - DNA, 2512 bp, Homo sapiens
ttgcagcctctcttccgcccggcggccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattgtaagctgggccaggagggggcctatgggaggaggcatgcccaactacccccactcttttttcagacccagcgttagccagagagaagcccagcctccgcctggagggagtggatgctgtgagcagctgggattcagaggcctgagtgggcctggaccaggctgggagggggcagagagaagggcagctcagcctcaaggctcaccaagagtaaagtaggaatgacagggatctgtcttcttgggcacccccaaccaccagccctagctcccctgctcatgcccgccctgtttccccagcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346985 - DNA, 1591 bp, Homo sapiens
aaattaaggctagtacgaggctggtgtaaatcggccgagggatcgcgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346986 - DNA, 2029 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacatgcaaactaatctgaaccatctagtagctggttccct

SEQ ID NO: 346987 - DNA, 785 bp, Homo sapiens
ggtgctctgcggatcttaccgactagccgacagctctgcatgtgtttcgggcccatgaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346988 - DNA, 1544 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagtcctagctggtgcattaaaacaagaaataagagatacaagaatcagaagaggagaaaccaaactgtcattgttttcagatgatatggttgtacctataaaacaccaaaacttttatagacaaattaagaattaataagctagcttaccaacttgctcaatcaataaacaaaaattcaattgc

SEQ ID NO: 346989 - DNA, 424 bp, Homo sapiens
gagcaagcacgtgcggtttcctgcggctcacctgctcacatgctgcctggggtggggacttgtgtgtccctgtggctgtgagtttgtgtgcacctctggcccgtgtgtgctcacgtcagtagctttgtctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346990 - DNA, 425 bp, Homo sapiens
aatgcctgaggtgtttggactaaaggcagtgggaagcaatttcagattcttgagtgaggagtaacatgacctgaggctcctgggagaggccaggcccccgggtcttgagttgtagggatttggaggcgaggtctgggttagggttagagtacggctgggactggttaaggaggcgtctactttcaagtaatcccagccgttttggggaatgtttatgttgtcttctgttgctctgtcttccccacaacttggagatttcttccatcccgcaggagaggagccaagagcaggcaaagaggaatctggagtttcagtctccaactctcagcccaccaatgaaagccactctatcaaagccatcctgaaaaatatgtacgtaggggaggttatcctatcttctaccccttgtcctctttctctcctcc

SEQ ID NO: 346991 - DNA, 826 bp, Homo sapiens
gcgccaagcttacttgggtggaggtggagacaggtttgcaggaaggagtgaaagacaaccccaccatacacgttccctcaaggaggagaagccaggttggggttaggcagccaggatgggttgatcaacagaatgaggttcgacagtcaagttgctccaccccacccctccttccacccagaggctctgggctggggtacagccattctgaggtagccttgcccttccttccccgcttagggaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccc

SEQ ID NO: 346992 - DNA, 2209 bp, Homo sapiens
taggctagtacgaggctggttgtaattggccgaggcagcgcgggagcagtgcttctgcggcaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346993 - DNA, 2285 bp, Homo sapiens
ctgcagcgagagcgcgcggatctcagcgcgggagcagtgcttctgcggcaggcttctcagaatggggccccatgaagcctgagggactctctcctgataacaccctgtgccacctttttcattctggatccgcacccaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346994 - DNA, 2309 bp, Homo sapiens
ccgcgcagcacgtggcgcgcacgggcgcagggagcctgaggaccctgcggggaccgggacccaagctgggcggggcggcctggctcccgggcctaaaacaggctgcggtcacgttgacctccgcaaggggcaggcgagtggacgggtgatccccatcgatctggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346995 - DNA, 2202 bp, Homo sapiens
ccgcgcagcacgtggcgcgcacgggcgcagggagcctgaggaccctgcggggaccgggacccaagctgggcggggcggcctggctcccgggcctaaaacaggctgcggtcacgttgacctccgcaaggggcaggcgagtggacgggtgatccccatcgatctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 346996 - DNA, 3134 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggctccctgtgtcctccagccgtggcttcatgccctggagtgggtagagggctggcagcctgagtctgggagatgagcatgacccagctgggccctggccaggactggacctgggtccaagggggaggaggggggagtagtcctcttggcctcagaggggctgcaatgccccctgctggggccacaggggagggacaggcctggaaccagaacaccaagactgttagccaagactaagaacgggtttttctttgctgcttcattctttctttcataggacagaggatggagatagctccccatctttcctttgtcttcactgccagcccctccactctgtccccagccccagcaatgaactctgcaaaactggccagctcctggcatactcccataccaccaggcaggaagaggccgaggcctgagggttctcccctacctggcacccagccttaacaccaaagctcagcctgccagacttcctggggaacaagggccctgtgtgtctgcacagtgaaaccaacccttcccttctcaacacaaactctggcctagggaggggtgggttgttatggaactatgagtgtctcagtggagaaggccctaccactgggacccccatctcaagaatgacctgactggaagtgagaccagagctctggccacagtgcagcacccctgcaatctgcattccttaccctcccacaagtctcagactcctcccagaaagcagaagacattcctgaattctcagcgcaggctgctcactcagccctggccagcagatggctacagagttggcacctttgtcagcgcttcctttctcactggagtttaatttaattgagaacttcaggcctcattaagggctgttagcgcatttttaaggctctttgatgagctctgaagccctaatggggtagctaagtataccagggcactgggaactgaagttcatgtgctattaatcatttgtcagaccagagtatttatctgcggtgctggaaaacaaggtattccttttggatcaggctcaaaagct

SEQ ID NO: 346997 - DNA, 2171 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcctccctccaatggcaaccaaacaacacagtagcgaatgatacacagattgcttacccaaatcatagtacaacaagagggggg

SEQ ID NO: 346998 - DNA, 2431 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggaaaaaaaaaaaaaaaaaaaaaaaaaaaaaaaaaaaaaaaaaaaaaaaaaaaaaaaaaaaaaaggggggggggggcacaaaaaatcccccgggggggggccatgggcgacccacgtttgtttggttgaaaaagggggggtccataagggggggggttattttaaaagagagcacgagggcgcgggattaaaaacagggatggggtggaggggaaaaaggtgagcggggaatattgtggggaagagaacccatctgtgcgggggggtgcaaacatgggggaacattccacggaggaattgaacggtcgagggaaataaaaattcgagaggtctttgggtgtaaccaacgtgtaatgtgtggtagaaaagagtgggtgggggttgtgtgacata

SEQ ID NO: 346999 - DNA, 2428 bp, Homo sapiens
ttgcagcctctcttccgcccggcggccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattgtaagctgggccaggagggggcctatgggaggaggcatgcccaactacccccactcttttttcagacccagcgttagccagagagaagcccagcctccgcctggagggagtggatgctgtgagcagctgggattcagaggcctgagtgggcctggaccaggctgggagggggcagagagaagggcagctcagcctcaaggctcaccaagagtaaacatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctcc

SEQ ID NO: 347000 - DNA, 2037 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgcctttttaatattgcagggtgggggggcgg

SEQ ID NO: 347001 - DNA, 1925 bp, Homo sapiens
ctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtgtgctgtccacctcctctgtgctgtccacctcctcctcctctgtgctgtcccctcccctctgtgctgtcca

SEQ ID NO: 347002 - DNA, 699 bp, Homo sapiens
  misc_feature (30)..(30): n is a, c, g, or t
cacgcgtcgcccacgcgtcgcccacgcgtncctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347003 - DNA, 445 bp, Homo sapiens
  misc_feature (18)..(18): n is a, c, g, or t
cccccccccccaaaaaanccccccccccccccaaaaaaagggggtttcttttccaaccctcaagggattttgggattggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347004 - DNA, 411 bp, Homo sapiens
agctccacttgccgtgagtacggctgggctgcttcagctgtaaattctcaggatggctcacttcacatttctttatagaattatctctactcggacctatctaaaggattatttaatttgtctaaaggattatttaatttggaattctaaagatagaacttctgcatataaaatcagaaagttagtgccccctcgaggcagtaaaagcacctggctgttgttggacattcataggctgtctttcccgcaggagtagaagcagcaagttacagaaaagaggctcactgtggccgggtgccgtggctcaggcctgcgatcccagcactgtggaaggctgaggtgggaggatcacttgagccccggagttcaagaccagcctggacaacatatagggagaccctgtctctattt

SEQ ID NO: 347005 - DNA, 353 bp, Homo sapiens
ctgtttgttcatatgtaaaaggggaacagctgcacttcttcagtcatgttcatgggagagtagtaaattttaagtgaaataatacatataaaagatgtttgaaaatggctagacagctgtgcagaaatgctggggataattcacccagcccgagcttttcatctctgatctgcccgaggtctggtttggcatctccaggccatgtactggaaagtggccacttccttcgctgcttcgtggctctgagttgagtaggactcatggtcagggtcaggactgctcttcttcctcagatcccacaaaggcaggtgcctgggctgatagatgattcctgtgtgggtttgatttcagga

SEQ ID NO: 347006 - DNA, 4252 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347007 - DNA, 4682 bp, Homo sapiens
  misc_feature (30)..(30): n is a, c, g, or t
  misc_feature (4261)..(4261): n is a, c, g, or t
  misc_feature (4266)..(4266): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaatttaaaaaaaaanaaaanaaaaaaaaaaaaaaaaaaaaaaaaaatttgtgggcgcgcgcgcgccgagcgcccccagaagaaagctcttcataacaaccactcgcgcgtgggggcgggcgcggggcgcccattatggagtataggtgggacaccgtcggggccatagagcgggtgtccccaggggagaaacaccgcggggaaacagagaaaaaaagggcggcgggggatctctctccctccccccatatataaaaaaaagagcgccgcgggggggaaaaacgaggaaaggccgtttcttgctgaaacacaatcgcgacaagaggggaggtctcccgaggggggcaacaacatcgagggggccatcaatctacacgcggggggggagcccacgagaggggagagccctccgaatatctacaaaataataaggcccg

SEQ ID NO: 347008 - DNA, 4065 bp, Homo sapiens
ctctggcccttacgcgctgctagcccttacgcgcctgctggaccttacgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347009 - DNA, 1852 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatacta

SEQ ID NO: 347010 - DNA, 3093 bp, Homo sapiens
ggctgctgcggtgttctagaggacccccagtgtctgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347011 - DNA, 3165 bp, Homo sapiens
agcgctgatctatacagcatgtagggaaatcccacatcaatggaaccatcacacagatgcctttctggaaccccaacctagcgctgagcaatcctgaatttggtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347012 - DNA, 3105 bp, Homo sapiens
gcagtatatcaggactgtggttatatctgtttcgtgagtagtaacatgatgtgtgcagtgatacctgtttccatgagtctgtaatgctggatgcgaggatagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347013 - DNA, 1668 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatacta

SEQ ID NO: 347014 - DNA, 1764 bp, Homo sapiens
ccctcgagtcgacggtatagataagcttgattctgatgtttgactggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347015 - DNA, 1323 bp, Homo sapiens
gactctatgaggatcgcccccagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347016 - DNA, 904 bp, Homo sapiens
gtctagaggatccctcactctagtcagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 347017 - DNA, 1666 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtgaatgccataacagatcagctactgaccatcatgcagcaagaggtgaaatggacccactggccctcaggaccccacagtg

SEQ ID NO: 347018 - DNA, 1578 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaatgattctcctgcttcagcctcccgagtagctgggactacaggcgtgcaccaccatgcctggctaatttttgtatttttagtagagacagggtttcaccatgtgggtcaggctggtctcaaactcctgacctcaggtgatccgcctgcctcggcctcccaaagtgttgggattgcaggtgtgagtcacctcccctggccttgaagtagatttttaaaagcttgca

SEQ ID NO: 347019 - DNA, 760 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcaaggggaaagccccaccgaagggaggatttaaaccat

SEQ ID NO: 347020 - DNA, 421 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcctacggttctgatttggcttgt

SEQ ID NO: 347021 - DNA, 801 bp, Homo sapiens
gcttcgtggctctgagttgagtaggactcatggtcagggtcaggactgctcttcttcctcagatcccacaaaggcaggtgcctgggctgatagatgattcctgtgtgggtttgatttcaggatttatttgtatcccagagaatgacaagtacgtggttcttgactttataaaaaaatgatttctctttcataggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtgtaagtgtacccggcacctgatgaacgtgcgtaacaagctccacttgccgtgagtacggctgggctgcttcagctgtaaattctcaggatggctcacttcacatttctttatagaattatctctactcggacctatctaaaggattatttaatttgtctaaaggattatttaatttggaattctaaagatagaacttctgcatataaaatcagaaagttagtgccccctcgaggcagtaaaagcacctggctgttgttggacattcataggctgtctttcccgcaggagtagaagcagcaagttacagaaaagaggctcactgtggccgggtgccgtggctcaggcctgcgatcccagcactgtggaaggctgaggtgggaggatcacttgagccccggagttcaagaccagcctggacaacatatagggagaccctgtctctatttaaaaaaaaga

SEQ ID NO: 347022 - DNA, 3337 bp, Homo sapiens
  misc_feature (30)..(30): n is a, c, g, or t
  misc_feature (3312)..(3313): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtctgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaaacttnnaaactaggggtccggctcgatcta

SEQ ID NO: 347023 - DNA, 1383 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgtaagtgagaaaaattgtgtgtgtgtgtgtgcgtgcatgcatatgcacatgtgtgcgcatgtgctgcaaccgttggtgtaggccctgctgacttccctgggtaagcgtatcctctgccactttagatttccaggtgagttaggacactaggcggagtggtggatgcttggaaaaacatgttacccattggttaagaaaaatctggtttttctcttcattttctctgttgttcagcagcagttatttcttgagcaactgcctaatccctggggggggttacaagggatccttctattaatattatcttagagggatgttcacagacgt

SEQ ID NO: 347024 - DNA, 721 bp, Homo sapiens
  misc_feature (30)..(30): n is a, c, g, or t
cacgcgtcgcccacgcgtcgcccacgcgtnccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgttacttaagcgacagcggggatacctcaagagacgaccagcagaatgc

SEQ ID NO: 347025 - DNA, 1233 bp, Homo sapiens
accacacatcttctattctgtctggggtttagcaaccatgtaattgttacatgaagtttcaaagtgtattgatgagttgtagctgattttgtttttctctttaaatatatgaacatttttaagaaattactaaacagaaaattttttcttagatgtattatatgcattaaacatagaaactgaaaaagaaattgtgttcctagtttattataactatttttcttttgctttgactcttcctgtgtgacttcattaactcatttcctcagggttttcaacacatcattttgatactggcagatgataacttacatgtgtagccctctttcaagtgttcgaaatgtgtattctttctaaatctaaagaaataattctgtaaaaatgttgatcttattatatgtattagtgctgatcttatacaaatttcattatctttcatctgatattcatatcaaaaattaatctcccattttgatagagatcctgcatgttagagattgaagaaacttgaatggccttataattttggaatcctaaactgtgttgtttagacattatgattatgtgtaactggagggtaggaagtcattaggaagcagttgtgggatatgcagagaccccatttgattgaaattttaggaacaaatttgtgtccgcagaataatcctttagttcaaatgagaaggatgcattagaattcaagttgcatattttagccaagtttagaataactgagcctagaaagtaactttcatatgatgtttttttctgtatgctttaggattaatttgtatcatttattgttccagtattaatgatactgttattgctatatattttaattggccaaaagctataccagataataattttggtgtttgttttgtcctgagtgggacatctgacatctagtaattgcaggagttaagatcttagaatggtttggcaagagactatagtgctgaagtaaatgctgtgttactttcttctatgttagtttttttccgaaagtattttcttttcacggtgttgatttctttttgcatattttagctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347026 - DNA, 1412 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatg

SEQ ID NO: 347027 - DNA, 892 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcacccaaggtgggagattttaggaactctcctatcaggcaattttatgccttgcacgggtcccttttggtttggtcagggtttacacagggtcgaaggcgggctcagatccctagtttcgggtccatagcctcagtggggttacggcgggcacggagagcaactgc

SEQ ID NO: 347028 - DNA, 393 bp, Homo sapiens
gtatgtcatgctttttacttacctgagaaactcagtcattaacattataggatcaatttccctgtgtttccttttagggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347029 - DNA, 1111 bp, Homo sapiens
accacacatcttctattctgtctggggtttagcaaccatgtaattgttacatgaagtttcaaagtgtattgatgagttgtagctgattttgtttttctctttaaatatatgaacatttttaagaaattactaaacagaaaattttttcttagatgtattatatgcattaaacatagaaactgaaaaagaaattgtgttcctagtttattataactatttttcttttgctttgactcttcctgtgtgacttcattaactcatttcctcagggttttcaacacatcattttgatactggcagatgataacttacatgtgtagccctctttcaagtgttcgaaatgtgtattctttctaaatctaaagaaataattctgtaaaaatgttgatcttattatatgtattagtgctgatcttatacaaatttcattatctttcatctgatattcatatcaaaaattaatctcccattttgatagagatcctgcatgttagagattgaagaaacttgaatggccttataattttggaatcctaaactgtgttgtttagacattatgattatgtgtaactggagggtaggaagtcattaggaagcagttgtgggatatgcagagaccccatttgattgaaattttaggaacaaatttgtgtccgcagaataatcctttagttcaaatgagaaggatgcattagaattcaagttgcatattttagccaagtttagaataactgagcctagaaagtaactttcatatgatgtttttttctgtatgctttaggattaatttgtatcatttattgttccagtattaatgatactgttattgctatatattttaattggccaaaagctataccagataataattttggtgtttgttttgtcctgagtgggacatctgacatctagtaattgcaggagttaagatcttagaatggtttggcaagagactatagtgctgaagtaaatgctgtgttactttcttctatgttagtttttttccgaaagtattttcttttcacggtgttgatttctttttgcatattttagctcctaactgggcaactcaagattctggcttctactgaagaaccataaagaaaagatg

SEQ ID NO: 347030 - DNA, 282 bp, Homo sapiens
gcggccgcctactactactactactgctcgaattcaagcttctaacgatgtacggggacatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347031 - DNA, 1857 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttaaaaaaaaaaaaaaaaaaaaaaaggcggccgccgcgccggcgggcggcaaggctccgggccagcatgggggcttcgtggtgactgtcaagcaagagcgcggcgagggtccacgcgcgggcgagaaggggtcccacgaggaggagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtgagca

SEQ ID NO: 347032 - DNA, 1854 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttaaaaaaaaaaaaaaaaaaaaaaaaaaaaaaaaacattttaaccaacattgcccaaattactttatacttaaacaaatttatgtcagcggcactctattctcagttaattagtccaatttcccttattgtggtcctatccaaatcactgcccatggttaacccctcttaactgggtaaccccggtttaacccacttaattgcctcgtactaattcctatttctcggctggcttaaaatgtaatggttcctaaccaattcgcctttataaacatgggtacatatttgatggtccattgtaaactgcacctttaaatattttgt

SEQ ID NO: 347033 - DNA, 1479 bp, Homo sapiens
  misc_feature (1441)..(1441): n is a, c, g, or t
  misc_feature (1453)..(1453): n is a, c, g, or t
  misc_feature (1455)..(1455): n is a, c, g, or t
  misc_feature (1458)..(1458): n is a, c, g, or t
  misc_feature (1461)..(1461): n is a, c, g, or t
  misc_feature (1469)..(1470): n is a, c, g, or t
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaaaaaaaanaaaaaaaatttngnggngcncgggcccnnaaaagtttt

SEQ ID NO: 347034 - DNA, 1462 bp, Homo sapiens
  misc_feature (1363)..(1363): n is a, c, g, or t
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagagctaactgggnactcagatctggttctatgagacataagaaagatgaacaaattcagaagatgaatataactatttaaggggctcctttggaccactttcgttattgaga

SEQ ID NO: 347035 - DNA, 1423 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagagcctaactggctactcaagattctggcttatatcgacagtcgggatcctctagatcatcacacgggcggct

SEQ ID NO: 347036 - DNA, 1542 bp, Homo sapiens
  misc_feature (1359)..(1359): n is a, c, g, or t
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagagcctaantgggcactccaacattctgcattatactgaagaaccataaatgaaatatcaacagacagtccatcaaagaaagatccaattcttccactctcatatacaggggctcttactttttgcaaaccacataggccgcattgattttcaacaattgcaatagcattgtttcgttttcatataagaata

SEQ ID NO: 347037 - DNA, 1426 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaagccagaatcttgagttgcccagttaggacctgctgacctgctattctgatcaagtttgtcgagcggtttttcatttcgtagtagtagtaggcgcacgc

SEQ ID NO: 347038 - DNA, 1465 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcgctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347039 - DNA, 1555 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattatttccctgtgtttccttttagggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347040 - DNA, 1769 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggaggttgtttcagcaatgtggatggagaagcatataggagtttattactgattacctggatgtggagaagtgacagctatatgtgctttacaggaaagatggtgtgggttttatttatacacagccttgcctagaaagggtaagagatggtttgtagggacacataaaaaataaggtcatgtaaatcagaagtaggtgggaatgtctacagtaattctcttcattttaaaatttttagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347041 - DNA, 1705 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagtagagacagggtttcaccgtgttagccaggatggtctcgatctcctgacctcgtgatccgcctgcctcggcctcccaaagtgctgggattacaggcgtgagccactgcgcctggcgacatccttaaaccttcatcttgacccctgttagtcactactcacaccccctaaagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347042 - DNA, 1557 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgtgctcttctgcatttttaattagctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347043 - DNA, 1609 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacgggttcacaaccaggaaggaaccccaaatttaaacgggaaaaaaattttttaaacaaaaacctttttaaaaaaaacttttttcccctttggtttggaaggttctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347044 - DNA, 1153 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggaggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347045 - DNA, 1195 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347046 - DNA, 799 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacagtaagttatttcactgtgtaatt

SEQ ID NO: 347047 - DNA, 1177 bp, Homo sapiens
  misc_feature (202)..(202): n is a, c, g, or t
  misc_feature (390)..(390): n is a, c, g, or t
  misc_feature (398)..(398): n is a, c, g, or t
gggccaacaatccacttcaccatgcccggcagatgaatttcagtggatccgggtgaaaccaacccatgtgcccaagggttggatcaagggcaatgccaatgacatcggcatggattatgattatgccctcctggaactcaaaaagcccccacaagagaaaatttatgaagattgggggtgagccctcctgctaagcagctgncagggggcagaattcacttctttggttatgacaatgaccgaccaggcaatttggtgtatcgcttctgtgacctcaaagacgagacctatgacttgctctaccagcaatgcgatgcccagccaggggccagcgggtctggggtctatgtgaggatgtggaagagacagcagcagaagtgggagcgaaanattattgncctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347048 - DNA, 3995 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctgatggagtcttgctatgttgcccaggctgatctcaaactcctggcctgaagtgatcctccctcctcagcctttcaatgctttgggatttacagccatgagcctctgcaccctgcctgtctaagatttctctagttaatcctagaagttggaaaaagaccttaaaacagagactttttgtcttccaaccttggaagagtttgtttctttttgcctttactttctggtgcttttttcttcacttgtagctccacatgttgcaaaataaagtctcatggctgctgtctgtggttattttctaggaaattaaaattttcattttgtggggagggagagattagtattactgattcaggtaatttctacacttaaattgcatagacaacttcactttttgaaactccaccatcctttaaagaaaaagattttctgtttatttccaactttgcttaagaaaaacaactttttttctttcttgcttccatttgtagatgaattcttaatttacagattagctgtggttcacttgcaagtgcattgaaggtaatcagtgatgctaaacttgtagtaacttatcaaaaaattccatcagttttactttgaatattacgagggatttaggagagcaaaagttgattactttggaaatgtaaacagcttaaacccggattgtaaaatcagaagcctggtatgattacaggtacatgaaaagagttggttatttatatcatttgttaatgctgggagtgaattttgagaatgaagatttagtgtcatgttaagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaacttgctacactgctacaaaaagcttttattctaacacatataacacattctagtgttaatagtattatatttatgtagtatggttttatattagtctgaaaatttctacaagtgacaggtttgtacttgtaggtttggtgaatttttatgtttatttttttaaaatatgacgatacaagttaattcccggtcttaaaaaaatttgagggttagttttaaacttttgcattgcccctaacaaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtataaattaaagctgtgtgaccctagaatctgcccttaaaaaaaaaaagaaaagactcgtggattttagaatacattgagaattgttcaggtacactctgtttggtgtgaaacttctttgatttatactccaagaaatgtgttaattgaaataaaatgacgaagctggtttggtgggaatttttgaacacttttgctttaacagttattagcactattgattattttgttaaaattttccctcattgtggcctttgatctggctccataatataccccattcccttattcagcagctctttgaaataaaagtgattttagttcctaggactatttgttatacttttggagctgtctctttccctccctcaggatgtaaaatgtatttcctgtttgtatataccacttcatttaaaaatatttttccttgaggctcaagacagtatgagtaatgataatttttagaggcattaggatcttgattgaaattctggctctgttgtatcctgttgtgatgtcactgtaagaattgtgcatttaatattgatcttcaagcatagttttgcatattttaacatctgaaatcagaaagtgtctttactgggtttttggttttagaaacataaaataataatgtatgttaaaattgatggcatttttgactcgatgatatatttttatattcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgtagattagttttgcctgttctagaattttatgtatgtaagtggaatgatgtactatgtatgtttgtgtttggcttatttttaccagcaagtttttgaggttcatgttattgtgtgtatcagaagttagtttctatttattgctcagtagtatttcattctgtgaatttaccatggtctgtttaatatattcatctattgatgatgaacatttagattacttttagtttttgcctattaaaaataaagttagtatgaatatgcatgtacaagttgtattgtggatatactttgtgataataactagaaccaggagtggttcaaaatttaatttacacatctactccctgtgttatttgcctgctcttagtgtgccaaatgttatttagtacatttgaaaggatgaatctcagtatagactgagtttgtattgtggtccccaatgtttagatcatatatctgtatacctatctctgcgatgattttcatcatcatttcagtaactcagatttaccaagttcttattctgtatcaggtgataattgtaatccctgtatgtcttatgtcacttaaactatacaactgaggtgggttctatccccatgttgcagtgaggaagctaaagtacaaactagctgttaagtggtagagacagaattcttgattggatttctgatcctgcacatataatttaacttgtaattatgatatctcttgatatttatactattatgtaaaagtgcttctgtaaaaaattaaatttgaaatttcaa

SEQ ID NO: 347049 - DNA, 3491 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctgatggagtcttgctatgttgcccaggctgatctcaaactcctggcctgaagtgatcctccctcctcagcctttcaatgctttgggatttacagccatgagcctctgcaccctgcctgtctaagatttctctagttaatcctagaagttggaaaaagaccttaaaacagagactttttgtcttccaaccttggaagagtttgtttctttttgcctttactttctggtgcttttttcttcacttgtagctccacatgttgcaaaataaagtctcatggctgctgtctgtggttattttctaggaaattaaaattttcattttgtggggagggagagattagtattactgattcaggtaatttctacacttaaattgcatagacaacttcactttttgaaactccaccatcctttaaagaaaaagattttctgtttatttccaactttgcttaagaaaaacaactttttttctttcttgcttccatttgtagatgaattcttaatttacagattagctgtggttcacttgcaagtgcattgaaggtaatcagtgatgctaaacttgtagtaacttatcaaaaaattccatcagttttactttgaatattacgagggatttaggagagcaaaagttgattactttggaaatgtaaacagcttaaacccggattgtaaaatcagaagcctggtatgattacaggtacatgaaaagagttggttatttatatcatttgttaatgctgggagtgaattttgagaatgaagatttagtgtcatgttaagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaacttgctacactgctacaaaaagcttttattctaacacatataacacattctagtgttaatagtattatatttatgtagtatggttttatattagtctgaaaatttctacaagtgacaggtttgtacttgtaggtttggtgaatttttatgtttatttttttaaaatatgacgatacaagttaattcccggtcttaaaaaaatttgagggttagttttaaacttttgcattgcccctaacaaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtataaattaaagctgtgtgaccctagaatctgcccttaaaaaaaaaaagaaaagactcgtggattttagaatacattgagaattgttcaggtacactctgtttggtgtgaaacttctttgatttatactccaagaaatgtgttaattgaaataaaatgacgaagctggtttggtgggaatttttgaacacttttgctttaacagttattagcactattgattattttgttaaaattttccctcattgtggcctttgatctggctccataatataccccattcccttattcagcagctctttgaaataaaagtgattttagttcctaggactatttgttatacttttggagctgtctctttccctccctcaggatgtaaaatgtatttcctgtttgtatataccacttcatttaaaaatatttttccttgaggctcaagacagtatgagtaatgataatttttagaggcattaggatcttgattgaaattctggctctgttgtatcctgttgtgatgtcactgtaagaattgtgcatttaatattgatcttcaagcatagttttgcatattttaacatctgaaatcagaaagtgtctttactgggtttttggttttagaaacataaaataataatgtatgttaaaattgatggcatttttgactcgatgatatatttttatattcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgtagattagttttgcctgttctagaattttatgtatgtaagtggaatgatgtactatgtatgtttgtgtttggcttatttttaccagcaagtttttgaggttcatgttattgtgtgtatcagaagttagtttctatttattgctcagtagtatttcattctgtgaatttaccatggtctgtttaatatattcatctattgatgatgaacatttagattacttttagtttttgcctattaaaaataaagttagtatgaatatgcatgta

SEQ ID NO: 347050 - DNA, 3937 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctgatggagtcttgctatgttgcccaggctgatctcaaactcctggcctgaagtgatcctccctcctcagcctttcaatgctttgggatttacagccatgagcctctgcaccctgcctgtctaagatttctctagttaatcctagaagttggatgcctttactttctggtgcttttttcttcacttgtagctccacatgttgcaaaataaagtctcatggctgctgtctgtggttattttctaggaaattaaaattttcattttgtggggagggagagattagtattactgattcaggtaatttctacacttaaattgcatagacaacttcactttttgaaactccaccatcctttaaagaaaaagattttctgtttatttccaactttgcttaagaaaaacaactttttttctttcttgcttccatttgtagatgaattcttaatttacagattagctgtggttcacttgcaagtgcattgaaggtaatcagtgatgctaaacttgtagtaacttatcaaaaaattccatcagttttactttgaatattacgagggatttaggagagcaaaagttgattactttggaaatgtaaacagcttaaacccggattgtaaaatcagaagcctggtatgattacaggtacatgaaaagagttggttatttatatcatttgttaatgctgggagtgaattttgagaatgaagatttagtgtcatgttaagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaacttgctacactgctacaaaaagcttttattctaacacatataacacattctagtgttaatagtattatatttatgtagtatggttttatattagtctgaaaatttctacaagtgacaggtttgtacttgtaggtttggtgaatttttatgtttatttttttaaaatatgacgatacaagttaattcccggtcttaaaaaaatttgagggttagttttaaacttttgcattgcccctaacaaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtataaattaaagctgtgtgaccctagaatctgcccttaaaaaaaaaaagaaaagactcgtggattttagaatacattgagaattgttcaggtacactctgtttggtgtgaaacttctttgatttatactccaagaaatgtgttaattgaaataaaatgacgaagctggtttggtgggaatttttgaacacttttgctttaacagttattagcactattgattattttgttaaaattttccctcattgtggcctttgatctggctccataatataccccattcccttattcagcagctctttgaaataaaagtgattttagttcctaggactatttgttatacttttggagctgtctctttccctccctcaggatgtaaaatgtatttcctgtttgtatataccacttcatttaaaaatatttttccttgaggctcaagacagtatgagtaatgataatttttagaggcattaggatcttgattgaaattctggctctgttgtatcctgttgtgatgtcactgtaagaattgtgcatttaatattgatcttcaagcatagttttgcatattttaacatctgaaatcagaaagtgtctttactgggtttttggttttagaaacataaaataataatgtatgttaaaattgatggcatttttgactcgatgatatatttttatattcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgtagattagttttgcctgttctagaattttatgtatgtaagtggaatgatgtactatgtatgtttgtgtttggcttatttttaccagcaagtttttgaggttcatgttattgtgtgtatcagaagttagtttctatttattgctcagtagtatttcattctgtgaatttaccatggtctgtttaatatattcatctattgatgatgaacatttagattacttttagtttttgcctattaaaaataaagttagtatgaatatgcatgtacaagttgtattgtggatatactttgtgataataactagaaccaggagtggttcaaaatttaatttacacatctactccctgtgttatttgcctgctcttagtgtgccaaatgttatttagtacatttgaaaggatgaatctcagtatagactgagtttgtattgtggtccccaatgtttagatcatatatctgtatacctatctctgcgatgattttcatcatcatttcagtaactcagatttaccaagttcttattctgtatcaggtgataattgtaatccctgtatgtcttatgtcacttaaactatacaactgaggtgggttctatccccatgttgcagtgaggaagctaaagtacaaactagctgttaagtggtagagacagaattcttgattggatttctgatcctgcacatataatttaacttgtaattatgatatctcttgatatttatactattatgtaaaagtgcttctgtaaaaaattaaatttgaaatttcaa

SEQ ID NO: 347051 - DNA, 469 bp, Homo sapiens
gcggacactactactaaaaaaaacgcggccgtctgacgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347052 - DNA, 709 bp, Homo sapiens
tccagcaacagatagaaatgctttaagttcactctggggaaagctggcctctgaaatcttaatgcagaattgggatgcagccatggaagaccttacacggttaaaagagaccatagataataatgtgagttcgactttttcacagttattctctgaaatatctgtgtatccttcacactttctgatgaggaaaatcactatgcattttgggaattaaaaaaaaaaattcatattagcttttgttgaccttacaaaaatcatagtggattagtggcttgactagtttgaatctccttgaatgaaattgtcagacttcttttggctcttagagaaaaaatgtagccttcatttctgttttacagctactgtgccctttttttctatgccagtcaaaatgacactatgctgttagtgccacctattattgaaagtcctatgcagaagacagttttcatctacaattatctaattaaaccacttactatgaaatgttcagtttaattcttgcttttaaaatgttttctgaaatgattataatttataacttctgtaagagtttataaattagagcgtcttcagtagacattattgaatctgtctctaagaacagggtaataatttggaatgtcgagggatcatgtagagagaaggcatagggggtcggacattgatcataatgacctccgtgcatgccttagaaggggctcat

SEQ ID NO: 347053 - DNA, 453 bp, Homo sapiens
gatgaatctcagtatagactgagtttgtattgtggtccccaatgtttagatcatatatctgtaaatatgtatacacatttacatatagataaatataaatttacgtatgtaaatgtatatgtaaatatatgtaaatctgtatacctatctctgcgatgattttcatcatcatttcagtaactcagatttaccaagttcttattctgtatcaggtgataattgtaatccctgtatgtcttatgtcacttaaactatacaactgaggtgggttctatccccatgttgcagtgaggaagctaaagtacaaactagctgttaagtggtagagacagaattcttgattggatttctgatcctgcacatataatttaacttgtaattatgatatctcttgatatttatactattatgtaaaagtgcttctgtaaaaaattaaatttgaaatttcaactt

SEQ ID NO: 347054 - DNA, 536 bp, Homo sapiens
  misc_feature (498)..(498): n is a, c, g, or t
  misc_feature (510)..(510): n is a, c, g, or t
  misc_feature (512)..(512): n is a, c, g, or t
  misc_feature (515)..(515): n is a, c, g, or t
  misc_feature (518)..(518): n is a, c, g, or t
  misc_feature (526)..(527): n is a, c, g, or t
gcggacactactactaaaaaaaacgcggccgtctgacgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttaaaaaaaaaaaaaaaaaaaaaaaaaaaaanaaaaaaaatttngnggngcncgggcccnnaaaagtttt

SEQ ID NO: 347055 - DNA, 1419 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347056 - DNA, 1575 bp, Homo sapiens
gcctttgctgcggcaagatgggggagtacgaattgactactcgtatcgagcagtgggggatcggcatctaggtcttcccgcggtctctgaatggctcgtctgtaggaggagcactatataactggaaggaaggaattgtgacgaggtgatcatggaccctattctatagctgaataccaaagcagtggtgaccatgtgtgcgctactgcgtgtgttgtacgagaaacccgtgttatgtcgtgaatgatactgtcactcatggctttttgatggagtagaacaaatgaacccaccaagtggcttgcaacaatcgtggatagatcgatgttttacagtggagaataccgagaaccacatgggtgaatgagtgtgtgaagaatccagaaggctacaaggcaaatgcaggtcaatccacgtggatggtaggactgcgtctttgactacctggcggacaggcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347057 - DNA, 1725 bp, Homo sapiens
  misc_feature (1632)..(1632): n is a, c, g, or t
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttatcttgctgtcagttttcttgcatgtgcaagtttgtgttttttttttttttttttaaagaaattagggaacaacagttttattggtaatagtcccaaangggaaacaactaaaatatccttcaataggtacatggttaaaccactggcacatcattaccagttaaaccaggtggcacatcaatactcatgta

SEQ ID NO: 347058 - DNA, 1791 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttaaaaaaaaaaaaaaaaaaaaaaaactgtgtgtgtgggcgcgcgcgggggccccggaaaagttttgaaaaccatgcgttggggcccgggggccccagggggtaagggaacccgggccacaagggggtacccaagagaaaacccgggcacaggaaatagggcggggctttccaccgcaaataaaaaacgcacggggggcaacacgcagccgtttctgaacaacctccgaaggggctccgagaggcaacacaggggaccag

SEQ ID NO: 347059 - DNA, 1534 bp, Homo sapiens
tgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgttggtttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 347060 - DNA, 716 bp, Homo sapiens
tgacatggcacaaaacaaacagcaataaagatgtagccataacacaaagaataaaaagaagggctgtgatgcatacacagttgggataaacataagtagacacacaaacaaaactaaaaataatcagaaaataagcagaatgtctctttaaattcagaaagagtcaattttgcagcataagaacaatgtcctctccatatacagaatcgattttatttcttcaccatgtgtatttctttatctttacttggagctacaaactaactccagcagaaatatttgcggccaataatggtgcatctattacacagcaagcattgtgtttgttacatttacatatcaaaatacctttatgacttatgaagcctccccagcatttacctaaacaaattggctgaatgaataaattcacctatgtcaattataaagagtaaaaggaacaataataaaggaaacttagcttacacaggtttctccaattaaaataacaaaatgggatgttctaactaaatgaaatataagttggtcggatgcagtggctcatgcctgtaatcccagctccttgggaggccaaggtgggtggaccaccaggtcaggagttcaaggccactctggccattatagtgaaacacagtctctactaaaaatacaaaaacattagctgggaatggtggcacatgcctgtagtcccagctacttaggaggctgaggcaaga

SEQ ID NO: 347061 - DNA, 1362 bp, Homo sapiens
gtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatgacaaaaaaaatttctga

SEQ ID NO: 347062 - DNA, 1026 bp, Homo sapiens
gttaatctatattgttatcagtacttcattcctttttactgctcattaatagtccattggatgaatatactacaatttgtttatccattcgcttgtacatttacatgcaagtctttgggtggacctatgtttttatctgggataaatagtgaaattgctggattgtatggtaactctgtaagaaaatggaaaacagtttccaagaggttccattttacattcactccagcagtgtctgagagttccacttgctctgaatccatgtcaacaattggtattgtccgtcttttaaattgtggccattcttacctgtgtgtcatatggtctgtctgtgcttttaatttgtgtctccttgattactgatgacattgagcatcttttcagatccttattggcccttcatatatatcttcttttataaagacaaaatcttctgcccatttttcattgagttgtcttgttactgacttgtaagagttcttcatatattctagttagaagtcctttgttggatatatatttgaatagtttctccaaatttatggcttatctgtttattttcttaatactattttgaggaacagagcttcatcttgttgaagtccagcttcttatgcttacactttttgtgtcctaagaaatcttcgcctaatcaagatcatggatattttctcctgttttattctaggcaatttgtagttttaatttttatctttcagcctgtaatcaatcaatctttgtgtatggtatgaggtaagggttcagggtttttgttttgttttgttttgtttttttgcatgtggatttacggttgtttcagtatcatttgttgaaagtatcccttctttttggttgtgtgggtccaggagctggaggaagacagggaggaaacctgtgggtgtggtggatgtattcattacactgtgatactttcatatgggcgggtatatatagcagaactcatcgaattgtccttttttttctttttctctgtggtccaggctggagtgcagtggcgctatctca

SEQ ID NO: 347063 - DNA, 518 bp, Homo sapiens
cgtactggaggatctaaccatttcaataagagaaaaaaacaaaaaaggagtaagagttataagtattggaaagaaaagagtaaactatccccatttgaagacaatataattgtctacagagaaaagtccaagagaaccaagaaactgttagaactaatgaaacttcagcaagattgcaagagaaacatcaatagtgttcttataaaccagtaatcaattacaacatgttattcagaatagcagtgaaagctctccaatacctaggcgtaatcttcatagagaaacattacaaaaatggagcagtgtttctacatttatagatacagacccagtgccccttctccccagatttattgattcagtatattttgaatcagtatccaaatgggttttttaatttgagttatacccaaaggaatataaattgttttattataaagaccaaatgggttttttcatgggaactcaaaaagttagtcttactatttctatggaaaagcaaagagccaagagtaaga

SEQ ID NO: 347064 - DNA, 991 bp, Homo sapiens
ttgagtacagtagtgctatcacagctcactgcagccttgaactcctgggctaaggatcctcctacctgagcctcctgagtagctgggactggtctccctctgttgtccaaggctggagtgtagtagtgctatcacagctgactgcagcctcaaccttccaggctgaagcgatcctcccatctcaacctcccacgtggctgagactacaggcgcttgccactatgcccaactaatatttggaattttcctatacgtggattccagaggggtgacagcgaaacgtgggaccatccagttgcaggaaaacgagcttaacacgcccactgattctacattatgctcctacctcccggcagcctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcggcctctccgggtgcaaaagttcctcgagtcagcctctccaggcccagctcctcctgcctcccagtgcctctttcggcccagcccagctcatgcctctgggcggccttcccaggccccgcttttgacttttggcggcctctgcaggcctcgacaaggcccggcctcctgcctcccgaagcctgcacaggcccagcctctgcctcacagcagactctccacgcccag

SEQ ID NO: 347065 - DNA, 1148 bp, Homo sapiens
atttttgtgactttgtaagcttttcccatatcattaatagcttttcataaaagtaatttttattggctgtatcataggccatcgtatgtgtgtcctatgcttgagttaatcattcctgtactgttaaacatttgggaggaaaaatttgttgtaatgttataaggacagatatgtgatttcagtctttaaatatgtcaacttgctcttaagcatatctgcatttatattcttttgaattgcagtcttatgatcgccacatatctgaaggggtaaaggtacattgtgggaacttgcatctggcctttggcagtttgaaccatgagctctttcttaatattgcctgtaaatatatttgtcctactgcaagaaattgttagtcttaaataccagaatttttgtttagaaaaagaaactgagtagccactttaaaataaaatacaatgtgttctagtataccaaattgtatttttgtcttagaaatatccaaattgatacagatgtcaataacatctctgtgatgtgtatgtcaataaacatctcccagaatacacccattgccttagtgtaggtttaatctctggaagtcactctgccatacttagaattaatcattctcaactgtaaagagcacattcagctcagtgactaacatctcattcctaagacctcaataactactaaggaattaagatatgtgcctctgttcttagaagtcaggttcagttcagtcccacaaacactagggcttcactggagtctgggttcagggtaggtagcaagaatcataatcataattgccccttagaattctcttgctctgcactgtgtgtgtaactcctaagaaagatgactactctttatttcaggctaattagaaaaggcaacatatctgaggtgtaaataataaataggattttatgtctactaagtagggtaataacagtccttttctaccattgatttatcagcgtatatatcttatgacttcagagtatatgcagagaaatggcagtaggggatgagagaattttagtatccccgttatgaaaaatacattgaaaaaaatggagaaattgggaagaatcttagtgactaagggagagggagcagctagctacaaaaggatgcaagaaaaggaattaagaaat

SEQ ID NO: 347066 - DNA, 1119 bp, Homo sapiens
gtcctgatagaagttcaaaggatagctagagctgggagggggtgagggagtgaatcgggaatctactgtcgtttgctagatagagcagatggctgttcaacaatcacagcgaaggttggaggaagtgatcggtgagttcggggggactagtgtgtcgtttcccgcgctatatccactacagggtcccgtcaaatctgggatgtaggatgaggctatggagcatgactcggatactcgtggatgacgagcggagacagagtgagagcgaggggcaaggtcaagcgaagctcccctactccgtggatgcgctcacgtgagaaatctgagtagacgcgtatcgtcggtggtatatggtagcagaaggtctcgtaaaaacagtagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttaaaaaatagagaagtcaggtatatctaagatttagaaagaaacttagcaaatgtgggttgcaggggtttcctgggggattaaaagtagggaagacactgtgaaaagaaatggaggaatagcgaagagtaagtaagaaaacagtagaatgaataagggagaaaagaccaagatacacaagagagagagaaggcgtgaccacaaacaaacggggagaggagaagagagaaggacaaaaaacaggagaacagagaaggtgaaaaaaaaaagagagcagagcaagacaagaaaagaacaagacacgaagaagaaaaacagggaacaaggagaaagaaaagacaagagcacacaccccagcgccccgcc

SEQ ID NO: 347067 - DNA, 508 bp, Homo sapiens
  misc_feature (5)..(5): n is a, c, g, or t
ccctngcctacgtcctggtaacctgtgctaccttctagatcttacttctactattttttttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcccaactaccggtcaactcacgtatgctctcgttctgattctctacgaccctgaaatgctctacccgt

SEQ ID NO: 347068 - DNA, 957 bp, Homo sapiens
atattgaactcgagttggaagaggcgagtccggtctcaaaatggaggtaaaaccgccgcccggtcgcccccagcccgactccggccgtcgccgtcgccgccggggggaggagggccatgatccaaaggaaccagagcagttgagaaaactgtttattggtggtctgagctttgaaactacagatgatagtttacgagaacattttgagaaatggggcacactcacagattgtgtggtaatgagagacccccaaacaaaacgttccaggggctttggttttgtgacttattcttgtgttgaagaggtggatgcagcaatgtgtgctcgaccacacaaggttgatgggcgtgtagtggaaccaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacataacctattcccccgagcaatttcaattacaatatatacaccaacaaacaatgttcaaccagtaactactactaatcaacgcccataatcatacaaagcccccgcaccaataggatcctcccgaatcaaccctgacccctctccttcataaattattcagcttcctacactattaaagtttaccacaaccaccaccccatcatactctttcacccacagcaccaatcctacctccatcgctaaccccactaaaacactcaccaagacctcaacccctgacccccatgcctcaggatactcctcaatagccatcgctgtagtatatccaaagacaaccatcattccccct

SEQ ID NO: 347069 - DNA, 781 bp, Homo sapiens
  misc_feature (2)..(2): n is a, c, g, or t
gnaccgctcccacttcagattggtaacaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaaggcttctgtttttagcagtttagtatagcgttgagttttcatgcatgtttgatattatcttatttaagttgtctcattgccttagaggaatttatatatcttgttctattttactcattgatcctagttcagataagttattgcagcttatacaggaataccttattttgtttgggacttgttattgctacatgtttgctaatagttcatatatcgtgttatcgctattaatttcttattctctcttcatttcttgaggttatatctattctggttacatactcttactgtctgtttcttttatattactcattattctataatatccttgctatattcctcctacgttttaccctagttgtactatatattactctttctttttcact

SEQ ID NO: 347070 - DNA, 5150 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgaaaaaaaacaccaccccagcctacacccacacacaccaacacacacacccaccggc

SEQ ID NO: 347071 - DNA, 5196 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatggtgtgtgttgttttgtcacttcacaatgttcatgtgacttaaacactataggtgaatattttgacttattttaccagtaagtaataaaacaacaggaaactt

SEQ ID NO: 347072 - DNA, 5699 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatgaaaaaaaaaaaaaaaaaaaaaaaaaaaaaaaaaaaaaaaaaaaaggggggggggcgctacaaaaaagtatacaccctccaaggagggagcgccccaattatgcagcgcgagacaccccgagaggtatgtggtgaaaaaaaagggggcgcccgcaatatagaggagagcgcgccagaatataataagaacgcagcagcgaagcgggcgacggcgcggtatacacacagggtggcgagagacggggggagaacaagcggggaaaagcggtggggcactctgcggggagaaggagagacccactataaactcttcggggggggggggggggagaacacaatttgtttggggcacaaaaacctctactcccatggaaagggaaagagatatatttacaagcgccccctcataagagggggggaaatatcatattagtagacaacactcttgtacgagggggtgtggtaataaactcaagggtgcggtgcgtacacaaacacaccgcgcgagcaattatatccgcggtcggccactgcggtgtataaaaaaaaatttgttgggccgtcacacagaagcgggagatatttatagattcttaacgaagagaa

SEQ ID NO: 347073 - DNA, 5048 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347074 - DNA, 4670 bp, Homo sapiens
  misc_feature (17)..(17): n is a, c, g, or t
agaggagtaacggtggntatgtctggcagtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347075 - DNA, 5187 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggtaggtatctttaaatttttattatgatgataaaagaatatgtggaactgttcactgagtgtaataatttttttatcctgtattattcaacaggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347076 - DNA, 4616 bp, Homo sapiens
  misc_feature (17)..(17): n is a, c, g, or t
agaggagtaacggtggntatgtctggcagtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347077 - DNA, 1772 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaaccccta

SEQ ID NO: 347078 - DNA, 2689 bp, Homo sapiens
ccacgcgtcggtgcttgggaaacattattttgaccaggtacccaggtttaagttatgaacattgacagtgtccattatataaccacacttgaagttatttaggacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347079 - DNA, 2442 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347080 - DNA, 2006 bp, Homo sapiens
cggtgttgttggtgatggtgaatgttgatggcaaaagtggtgttgatggatactgatgatgtggtgataatagtggtcataatggtggtggtggtggtgccgaaagtggaggtggtagtgtttaatggtagtgacaatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347081 - DNA, 2384 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347082 - DNA, 1679 bp, Homo sapiens
ctaacaccataaaaacccaacaagaaaacctaggccataccgttcaggacataggcacgggcacattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347083 - DNA, 1014 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaactttt

SEQ ID NO: 347084 - DNA, 1121 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcatacgcccagtatttggccgggtaatgtggcatgtcccggcatacacataggatttaccttcacattggtcgtcggtccaacttagtccgaattacaagggtcgagggtccggagtccgtaacacggtccatgttatggaaggaccgcgggggaatccccccaggcggaaagagggaaaaag

SEQ ID NO: 347085 - DNA, 1139 bp, Homo sapiens
aagtggctgtgatacacagtagtccactaggagcctccttgattccgcccattagggccacagtggatttgttgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347086 - DNA, 611 bp, Homo sapiens
cagcggggacaatcacttatagaacaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347087 - DNA, 1191 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcagtcttctatctgtagtagcttttgcttcttcctttctctttcattacattacggatatttgctctgtacatggtgttagtggtaccaacaattataatatttaaggactctttaacttctcaatatttctgtatctcaggtcttctgctttttatcctagatgcttaaccatatgcacgttctaacgtgttctctcttgtagttactctgttcttagtcccttgtaattcttatttcgctcattttctttagtctctatgttcctctcttctggacttctcttttagcgttgttctattcccccattcttataccctgtcttccatggttctcgcacttctctctgcccc

SEQ ID NO: 347088 - DNA, 931 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcacggaacagtaccacacttgcaagcacggcagcttgactgtatcaggatctctcataatctcaccagttacaggaacgtgcacgctgagtgattaatccaattcacagtcaaagagtattccatgtcgtaaacctttttgcgggagatgaggtccg

SEQ ID NO: 347089 - DNA, 856 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagaggttatattaaggaagatcttgatccttgtcctcgtccaaaagacgtcagccttacacgcatattttctccaaaggcaggagcgaagacatagacgttgaaacagaaacagaaggatgaaggacgttttttccttcttagttatttatagttaaagctgtacag

SEQ ID NO: 347090 - DNA, 1046 bp, Homo sapiens
  misc_feature (1046)..(1046): n is a, c, g, or t
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttgaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaactctttgtccatttctcgagccttctacccgccgcacctctctcttcatctcttccttcttttcactcactctccttcctcttgtaccctctcctctcgtccctttcactcttcccttctcccctttttccctttgtccttttttgccacctcccccgtctcttccattttccttccttcaccctctcttcatcatgtcctctcccacgatcttatccttctctatttctctctcccn

SEQ ID NO: 347091 - DNA, 987 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtgctatggtggtggtgggaactataatgatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcatcttgtttatagtcatctttgtactgtaatttgatgtacacaacattaaaagtactgacacctgagaatttctgctcaagtagtatcagtgatcatttacacattggaggggtcttgggtttacagccatgtgacaatcaaaagcactaaagggcagatcatgttcaagctcttaattatattacaccgtagccttgtctttcaaaagttgttgctcctgactcttctccctgctcctcaggttcaattcaaccgttcctacgtttctgcacattagttgagtaagctcttagcttgcgcttaactcatgcgccctccgaaacacc

SEQ ID NO: 347092 - DNA, 123 bp, Homo sapiens
ttgtttcttgacttaatatattactttatttgtaggattctgtaaagcctggtgcccatctaacagtgaagaaaatttttgttggtggtattaaagaagatacagaagaatataatttgagag

SEQ ID NO: 347093 - DNA, 405 bp, Homo sapiens
caaaagtgcactcttctatatctacaaagagagctgtttctagagaggattctgtaaagcctggtgcccatctaacagtgaagaaaatttttgttggtggtattaaagaagatacagaagaatataatttgagagactactttgaaaagtatggcaagattgaaaccatagaagttatggaagacaggcagagtggaaaaaagagaggatttgcttttgtaacttttgatgatcatgatacagttgataaaattgttgttcagaaataccacactattaatgggcataattgtgaagtgaaaaaggccctttctaaacaagagatgcagtctgctggatcacagagaggtctggaggtggatctggcattttatggacacgaatgttcaggtaccgaaatcgaag

SEQ ID NO: 347094 - DNA, 5094 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347095 - DNA, 5070 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagtgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347096 - DNA, 5040 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttattgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347097 - DNA, 5040 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagagccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347098 - DNA, 4113 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtctcaagttcttttattcatataaataaagtttaaaggaatgggggagattaacatttcctgttttatgtttgtgaaattgtttgacacaaccttgacagtatcctttaatggcatgaggttaattgtactgttaaccaactttctatgttctggaactagtattatagtgaaaacatttacagtaagttgatgtttacaacctataagcaggtgaaatctgtgtatgtgacctgtttataagttgtattagcttagctcttgtgaacagtgtggaaaagtaagccatgaggagagcgatttaaccacctttaaaggacctaagatgtgctttttaagcacagtgtggatcacagaaactcactaagacaggacttcagcagccttttgtgtttggacaagtcagcataaataaagaatgacaaggcagcagcaagagcttcaactacagagaagtgaaggcataagatactatgatgatagtgagcaactttccaaaagctagttaaatctgcttattacaactgaaatatcgaagaaagtctagcaggaaggagctcttcgccttttggaacatcaatgagagatagttgccacagtcactaggtctagcatttagacctgcaaggaagggcaataagcattaggtaaggcttgaatttgaattttttcactaattaaagagtaattttttgtaaagcaaggtaagagtaatctttttgatttgcaggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagtgcccgccaatcgaagggtaccgagcctcgagatcgt

SEQ ID NO: 347099 - DNA, 2571 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattaatgggtaccttttttttcttatttaaagcacaagaggcccataaatcttgagttactttaaattcttttttttgatacaagttttcagagcaagagaataaaaatcatgtgttattaaacccctaactggctggcatgctttcctgtttgtattctatacattttgctggatgaaaccaaggatagttcaggtataattgtccaaaataacctaactgcagcagaaatgtagcacagttgcttagtacaggcttctcacttcctacagacctgaattcaaatttggatagtctgagttcttaaattcccaaagaacacactgttatttcttgtgtatatttcaacataaatcatgttgttaccaatttgtttggaaggccctggttgagaagagttttagttaataaggtcatatatacatatattaatataaaccaatgtctactgttttgctccagctagtgcttacagtttcattcgagccctgagtatgtgccctgctgttactctctttggtagttgaacgttgaattcaagtcttttgttttaagaagtactaagcaaacaagcaataaaaaggggaatggggtgtgctagtgtttgaatatgctctcttgttgctctaattctgtgcctctgtgcattaatatttggatgcatgcaatgccagcatggaaattggtcttcacatatactgcagttttccagaaacattcacaaaccaataaatgtaacagacattccatttgttaatgggcatatatgtgaaaagcagtgtagaaaataggctaatattagaaaatggttaagtcctaaataacttcaagtgtggttatataatggacactgtcaatgttcataacttaaacctgggtacctggtcaaaataatgcttgggaaacattaaaattgagctaaattgtc

SEQ ID NO: 347100 - DNA, 1368 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatt

SEQ ID NO: 347101 - DNA, 2379 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggttgaatgagaaccctacttgcctaaatgaggaatgtctttcctaccatctaaaatacgaaggtttctggctgggtaaggtttgtagttgacagtaaaacctgatgacaccatttgtttccctgcaagtctacattacatatttcacaactttgtccctctctagtaggcacattggaaaaattcttcaactgaaaactaccttggtaccatgtcctacacgttttaaaccttagttttaaaaattcccctgcgaaatagccataagtattcatatcaagtcagttgtgactccttgtgtatacaattcattttttgtgtcttcagggtaaactcaatttttggtaaagtggtttcagcttttgtgaaaaccgtttttgtgtgtaagcatgacacacaacagactcagtaagctgcccatcctcatactaggaaaacaccttcaaaggaacattaaaagttaccagggccaggcacagtggctcacgcctgtaatcccagcactttgggaggctgaggcagatggatcccaagtccaggaatttgagacgagcctgggcaacatagtgagagcctgtcaacaaaaaatagaaaaattagctgggcttggtgatacacatctgtagtcccagctatttgggaggctgccttgatatcaggcagtcgaggctgcagtgagctgactgccccactgtattccagcctgggtgaccccatctcaaagaagaaaagttaccagatgtcatgggtaaaggttggtcttcaagtggcctcataagttgtcttgcatttaaattcagggaattcattggaccaataggttacattttcgttccttttttgttttggttcatctgttaagcagtgggggcctaattactgctcctttgtaaaaacacattttcccaaagaacactgaattaccgttcaaactggttgttgatgggtaataagggctgtttttgctgccccaaaagggcttaacaatttaggcggatagtttacttaaaaaaaaaaatcctttggagacatactgaaaatgcaaactagtttctaaattatcaattccctacatgaagaagcagtttgccagagtttagtctcagaaaatgactggttggctctatttaaatcagaacccaatttctacgcgtgttgaataaggtaacagcctttgatgaatttccttcacaacatggttttagtgaagcaaacattttttttttaagggcattgttctttctagtttatttctttttatgaaataaaattattttatttaaacagttccattgtcgtttctgaaaactacagtattctcagaagttgtagcagcagtaaaaaaaaaaaagttgttctataagtgattggggcagatttaactgattttgttaaaccaatttgtaagttactgcttctaatattacacttctaaaaagctgaatttatactcatgtcctaaaggagaatatgtggtaataaagtatatttgttaagtaactaattgaaataggcttggttttaagagttccagtatataataatcacaaattgaaacctgacagtatcttgggagttccagtaatgtcacaaattagtgaataagcatgccagtgtgcaagggtaatgtaaggattgttagcctatctaaatattcaaaattactttaaaacttaagtatgttttctgatttttaagaattcagaagtgttctgtaatggattcagatgtttcatttgtagtataatgaaatgtttacagaaagataactttttcattaaaatatttttagaaatg

SEQ ID NO: 347102 - DNA, 1159 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttaaaaaaaaaaaaaaaaaaaaaaaccgcgggatatatatgcgggggggagaaaaaggtcagagaagaggcacatggtaagtggttccggacccattttgaaaaggggaaacggggccccaaagggggaataaatggaaagcggtag

SEQ ID NO: 347103 - DNA, 1023 bp, Homo sapiens
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaaccacccgcccccagccctcccctcttggccccgcactgtgtaaaagatacgcgcaattagtctctaaatagtttattttaaaacgcgtctgggtttgtgcccggttgttctttgtattggatccatttaagtaaaaataaaattggttctttattt

SEQ ID NO: 347104 - DNA, 676 bp, Homo sapiens
  misc_feature (669)..(669): n is a, c, g, or t
atcgtgcagaagatcaccttatcgtgcagaagatcacctcatcgtgcagaagatcaccttatcgtgcagaagatcacctcatcgtgcagaagatcacctttctaaacaagagatgcagtctgctggatcacagagaggtcgtggaggtggatctggcaattttatgggtcgcggagggaactttggaggtggtggaggtaattttggccgtggtggaaactttggtggaagaggaggctatggtggtggaggtggtggcagcagaggtagttatggaggaggtgatggtggatataatggatttggaggtgatggtggcaactatggcggtggtcctggttatagtagtagagggggctatggtggtggtggaccaggatatggaaaccaaggtggtggatatggtggaggtggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaaggctacagtccttttctgggagagnggtcgga

SEQ ID NO: 347105 - DNA, 932 bp, Homo sapiens
tgagtaggtgggattacaggcgtgtgccaccatgcctggctaacttttttgtatttttagtagagacggggtatcgccatgttgaccaggctggtctcgaactcctgacctaaggggatccacctgcctcagcctcccaaagtactgggattacaggcgtgagccaccatgcctggccgctgcgtagcatttctgataggggctggtggtagggaaggagcattaaaacaagaatattagtagcacaagcagcaccattcttgaatgtctgctctgtactaggaattgtaataggaactttagtcatttagtcatcatgacctggtgagtgaggattaggttcacttgaatagagtagaaaacccaagataatggtggcttcataatggaaaagtttctaatgtaaccaaaaaaaggcctagaaaggtaggtggtactgggtttgtatgatggttccaaagcagcaggactaggctggtaactagcacctctgctactggttacattcctgttttacaaattagcatttctggttggataatttgtccaaggttatatagccagcagcaggggcatgatcagggtcagatttatctgactccacggtgtccatggtttttccatttttaccaccagcctcaatacctgaatcttcaatttttctcttgtggtggtgattttaagctaataaaaatggacttaacctattgtctttatattgcaacccatacagatgtgggtgtagcgtatatctgaaacaaaagtttcaaaatactgtttaattttattgtctgtactgtgctcttatattttctgtttcatattttttaagtaacccattaaattgattttgtaataactcttctagtgggatgctttataccagaagtgtccaaggaagagaatacagtcatgggttcctagtttctgtt

SEQ ID NO: 347106 - DNA, 1244 bp, Homo sapiens
tgcaagtaacaaagttctgccctggtgtgttgtttgcggataatcacagggcatgtaagggacagacagaaaacagcatgcttatcccagataattatagcaaggagaccaagaagcgtatttaaaatcttgatgttttgagtttcttcctagcttccccctattccttaataaagttctaaattgttttgttggagctctttgcagccattctgagggctttgcatgcttttctgaccttgcagtaaactcaatgctttaggcaaagaatggccacgtcatccgaccccctcagagtttagaattcagaacaggtctgaagaagaccaggcagcggctgagtcaaggaaagcctccgtccgcttttatttcccctgtgcctcttccaggactgtgctgggataacaggctcccgggggttactttggctgggctgggctaaaacctccctgcagagcaggccctgagccctgcctctgcgcctgggtggtgtcagcccctccaccttctgactgttccagcaactctctaagccctcccaaaggcctcaaggcctgtaagcatatgcagcaattttcagccataccaggagaggtcaactgtaatcttggccacctgcctaagaggaagtggctagcttcacttctgaccctcagcaactgccaggtggcctcttggaaatccccctctgggggattccacccgttgggtgggagagcagtagttaaaatgtaaaataagaatcttttgctgggagaagtcaacagatagggagaagtcagctgataacagaaatagttttttttttttttaaaactaacttcactgttaaccaagcagttcaacatgaaagactgaatctcttatgtttaatattttcttctcttttaatcttcataactaatttttttcagataattgtataaaataaccatggtagcaaaataatgtgatcactggaaaataagcagggaaaaacatgctatgaagatactcctatctgggtgaattcttgatagctttacatttttcatctggcatttaaacattaaacagttaatgtatttgacatgaaaattatttcaagttatcttattagttttaatagagtttaaaaagtgtttaaaagagttttcaaaaggctctaaaatcattttgaaatagtttaaaacagttttgaatcgttgtaagttagttttaatagagctttaaaaaggccctaaaatagtcctatcaagttgttg

SEQ ID NO: 347107 - DNA, 1166 bp, Homo sapiens
cccgaactaagaaagcacggctgtgtgggagcattgcatgccggagccctaaccccagctctcagcggcttctgatcacacagacctatgaggactgtccctggtgatgacaccgagcccccatgaaacggtgagatcctgctctgtgtgtttcattcagggagaaagggaagaagacaagcttgatttttaagatttccatgcagaatggtgaggcacactcggtgggcagcacccactggcagtgcccaggaaagatgtgtttcctctgttgctcctggactgagttttcatcgtcgagagctcgagctgcaggtgagaagggaagcatctgccacgccaggggccagggatcgagggtccaggacagaggtgagagaatctgctttggagttcagcctgtctcaagggctctccttccgcttcccagaaaagactctggagacagcaggtctatggggccaagaaggtctcatgtgcatccccatatgggactagggcccaggccacccaaaaccaggccctctccagccaggtgtaggcgagctgggctccatgcaccacctgggctggggccgcggtgactccatgtgagttcccgaggccagaaactcatcccttccttgccagggaactctgggatggttcctaagtgctctacaactggatcatgtttttcctaaatcaacactaaattttcccctttaaaaaagtacttaatgcccactctctacaaatggattttgtctgttcaactacaaatacgaggggatttcctcggaccttctgtccggctttggaatcataaggtattatagacccagaaaggccctttaagtagaggggaaactgaggacctaagagggcctgatacccagcaccattgctgtctcacacacactgaccctttgcctttcactgtgagctctgcccttggggacccgggtcctaggcaactaggacatttcaccggcaggaaacccgtgctgccaaggagagcccttggggctgactcagaaagcgtactttttttttcttttaactcgtctgtatttgttacaactttaagcagaatgtgacttgggcactatatttccatccacaagcctggctctgagttattattattattgttattataattattttgagatggagtttcgctc

SEQ ID NO: 347108 - DNA, 769 bp, Homo sapiens
gcagcgctgtaagaagtacctctaggcctgggaggcattgagaaaaaggaagtgggtcctgttctggttcttgcgactatagtcacctcccgaggcaaatgaccactgtcctgagaggacgtgggtgaggggcaggtgagtagagggatggcagcatctgtggactgagcaagaagaatctctgatgtctgtcctgagccttccggtcagtgatggggtcggtcagtggatggaatagtggaagtcggagcgatctctgatggaggatgactatgggaactaaggagggatctgaggagtgtgaatgatgcacatcttaattagtttcctctcttttatacgtaccgatctgtttatattttcgtttctgtttcattataatgatatattttgctaaagatttaaagaatatattacatagaattgcatgtttccatttccattttgttctctttcatatccagactagtagctcctttatcattacggttattatatttatatatcattcattctttctctatttaaaaagaatcaagcgtctgaaaggtttatctgtttcattggacattttgaaatgtccaataaaatactccctactcttttaatattaatttttttctctttttctttttaggtactttctctttttcccactttttgatgtaatttgttgttctttcccttattttcttaagttttatgcgggatacatttagggttgtaaagtttctttaagtacatctttatgaaatgcataagttcattt

SEQ ID NO: 347109 - DNA, 368 bp, Homo sapiens
gcagcgctgtaagaagtacctctaggcctgggaggcattgagaaaaaggaagtgggtcctgttctggttcttgcgactatagtcacctcccgaggcaaatgaccactgtcctgagaggacgtgggtgaggggcaggaatcagtgtcattcaaggacgtaactgtagacttcagtagggatgagtggcaacaattagaccttgctcagaaaagcctgtacagagaagtgatgctggaaaactatttcaacttgatctcagtgggatgtcaagttcccaaaccagaagtcatcttcagcttggaacaagaagagccatgtatgttggatggtgagatccccagtcagagccgtccaggtgagaagggaac

SEQ ID NO: 347110 - DNA, 280 bp, Homo sapiens
aaaggtttttttttttgaattcaaatatattctttaaaaaattattttaaagtttgttttttttttttaacaggaatcagtgtcattcaaggacgtaactgtagacttcagtagggatgagtggcaacaattagaccttgctcagaaaagcctgtacagagaagtgatgctggaaaactatttcaacttgatctcagtgggtaagcacggctctgctgggtatagagtaggctgcacctaattgagtatatttttcttctcagtagaattgctgaagtct

SEQ ID NO: 347111 - DNA, 856 bp, Homo sapiens
cttcccagcaatatgcatcttgcacgtctggtcggctcctgctccctccttctgctactgggggcctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaagggaaggaagcagacaaagcggtccaagggttccacactggggtccaccaggctgggaaggaagcagagaaacttggccaaggggtcgtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347112 - DNA, 552 bp, Homo sapiens
ccctgggaaaacgcttctacagcagctctccgctcttccaagctcaaagagctgtgggggatgtaggtggcaacacctaggcaacgtaactcaaccgcaagctcctcgaccttggaacggctatccacaaaaacgaggcgcttctcgcctttgtgcaatcttgaaatcacaattgctgcgtctttcagcgacccgacccaatcgacctggacgtcaggaatcacattattctcagcaggagggttgatcacgctccttcttgctgcacagggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347113 - DNA, 359 bp, Homo sapiens
ttgcgggtctgcatcggtgtctgcgagagcgccagctatcctgagggaaacttcggagggaaccacgactgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347114 - DNA, 901 bp, Homo sapiens
cttcccagcaatatgcatcttgcacgtctggtcggctcctgctccctccttctgctactgggggcctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacagggaaggaagcagacaaagcggtccaagggttccacactggggtccaccaggctgggaaggaagcagagaaacttggccaaggggtcgtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347115 - DNA, 904 bp, Homo sapiens
cttcccagcaatatgcatcttgcacgtctggtcggctcctgctccctccttctgctactgggggcctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggttgggaaggaggcagacaaactgatccatcatggggtccatcacggggccaaccaggcgggaagtgaggcagggaagtttggccaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347116 - DNA, 668 bp, Homo sapiens
cttcccagcaatatgcatcttgcacgtctggtcggctcctgctccctccttctgctactgggggcctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacagggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347117 - DNA, 1567 bp, Homo sapiens
cttcccagcaatatgcatcttgcacgtctggtcggctcctgctccctccttctgctactgggggcctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggttgggaaggaggcagacaaactgatccatcatggggtccatcacggggccaaccaggcgggaagtgaggcagggaagtttggccaggggttggccagggggtccaccatactgctggtcaggttgggaaggaggcagagaagtttggccagggggcccaccatgctgcggggcaggccggaaatgaggcagggacgatttggccagggggcccaccatgctgcggggcaggccggaaatgaggctgggaggtttggccagggggtccaccatggtctcagtgagggctggaaggagacagagaagtttggccagggggtccaccatgctgccagtcagtttgggaaggaaacagagaagctcggcatggggtccaccatggggttaatgaggcctggaaggaagcagagaagtttggccagggtgtccaccatgctgcctcgcaggtggggaaggaggaagacagagtggtccaaggcctccatcatggcgttagtcaggctggaagggaggcggggcagtttggccacgacattcaccacacagcagggcaggctgggaaagagggagacatagcagttcatggtgtccaacctggggtccacgaggccgggaaggaggcagggcagtttggccagggagttcaccatacccttgaacaggccgggaaggaagcagacaaagcggtccaagggttccacactggggtccaccaggctgggaaggaagcagagaaacttggccaaggggtcgtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacactaaact

SEQ ID NO: 347118 - DNA, 1926 bp, Homo sapiens
  misc_feature (1040)..(1040): n is a, c, g, or t
  misc_feature (1101)..(1101): n is a, c, g, or t
  misc_feature (1255)..(1255): n is a, c, g, or t
  misc_feature (1569)..(1569): n is a, c, g, or t
gagtgtttctggtggaatgctggattgttaatcgtgttagatggaattatgaccttgttgttgtctttatgtggcagttaagtatggtttaaagagatgtttatgggtgccaagttgacaagggtagacttgtgatggttaattttatatgtcaacttgaataggccacagggtgccagatatctgtttaaacattattctgaagtgtcttgagtgtgtttacagacgagatttgcatttgaactgggggactcagtaaaggagatagccatccccaaggtgggtggacatcatccagtttgttgagggcgtaaataaaataaaaggcagaggaaggaagaattcacccccctttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattagaccaatctataaaacagatagctatgaaagagaaaggtgacaggcacaagcctaggcaaatagagaagggttcctggagagcctctgacttgcctaggtcattgtgcacacgtggcttgcctgaatgaacatgcccactgtgaaagattccatttctcaacacatgtgcagtaagggaaataaatcaatgtggctcagactaagcgcccacacatggggtggagccacgaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcctttcagtgtgtacgcgtgcctaattttttctggtcatgtgataacccaaatttaactgaactaaggagcaaaaaatcctgcatcngctacattaatagctgattgtactagattgagtagtgtccccccaacaaaattcgtgtccnactgaaacctgtgaatatgctcctatttggaattagggactttgcagatgtaatcaagttaagacaaggttgtacttgattaggatgggccctaaatccaatatctcttgtgtccttgtaagaacaggaaaatctgaacacagaaacagagacntagggccatatgaagacagaggcagaggttggagtgatgagtcaatgagtaaaggaatgccaggggttgctagcaactgccagaggctggaagaggcaggcaaggattcttccttcaaggcttcagagggagcatggtccagcccacacctttatttcagacacctagcctcaagaactgtgagagaatgcattggttttacaacaaacagttgtaaaactgtgagaggatgtgtttgttttacaacaaacagttacccagttggtggcactgttacagtagctctcagaaattaatacgctgagtacaaagtnaaaagctaattaggaatagacatggacactgatatggtttggatttgtgtccccactcaaatctcatgttgaattttaatcccctagtattggaggaggtgcatggtgagaggtgattggatcatgggggcagacttgctccttgctgttgtcgtgatagtgagttcttagcgagatctggttgtttaaaagtgtgtagcactccctcttcgctctcttcctcctgctccaaccatgtggacgtgcctccttcctcttcaccttgtgccctgattttaagcttcctgaggcctccccagccatgcttcctgtacggcctgtggaaccgtgagccaattaaacttcttttctttaccc

SEQ ID NO: 347119 - DNA, 905 bp, Homo sapiens
gggacgcccatggaacgcagcgaaggactatggcaggggagaacttcgctacgccgttccacgggcacgtgggccgcggcgccttcagcgacgtgtacgagcccgcggaggacacgtttctgcttttggacgcgctcgaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaat

SEQ ID NO: 347120 - DNA, 779 bp, Homo sapiens
gggacgcccatggaacgcagcgaaggactatggcaggggagaacttcgctacgccgttccacgggcacgtgggccgcggcgccttcagcgacgtgtacgagcccgcggaggacacgtttctgcttttggacgcgctcgaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattat

SEQ ID NO: 347121 - DNA, 995 bp, Homo sapiens
gggacgcccatggaacgcagcgaaggactatggcaggggagaacttcgctacgccgttccacgggcacgtgggccgcggcgccttcagcgacgtgtacgagcccgcggaggacacgtttctgcttttggacgcgctcgaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttca

SEQ ID NO: 347122 - DNA, 2267 bp, Homo sapiens
  misc_feature (1381)..(1381): n is a, c, g, or t
  misc_feature (1442)..(1442): n is a, c, g, or t
  misc_feature (1596)..(1596): n is a, c, g, or t
  misc_feature (1910)..(1910): n is a, c, g, or t
gggacgcccatggaacgcagcgaaggactatggcaggggagaacttcgctacgccgttccacgggcacgtgggccgcggcgccttcagcgacgtgtacgagcccgcggaggacacgtttctgcttttggacgcgctcgaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattagaccaatctataaaacagatagctatgaaagagaaaggtgacaggcacaagcctaggcaaatagagaagggttcctggagagcctctgacttgcctaggtcattgtgcacacgtggcttgcctgaatgaacatgcccactgtgaaagattccatttctcaacacatgtgcagtaagggaaataaatcaatgtggctcagactaagcgcccacacatggggtggagccacgaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcctttcagtgtgtacgcgtgcctaattttttctggtcatgtgataacccaaatttaactgaactaaggagcaaaaaatcctgcatcngctacattaatagctgattgtactagattgagtagtgtccccccaacaaaattcgtgtccnactgaaacctgtgaatatgctcctatttggaattagggactttgcagatgtaatcaagttaagacaaggttgtacttgattaggatgggccctaaatccaatatctcttgtgtccttgtaagaacaggaaaatctgaacacagaaacagagacntagggccatatgaagacagaggcagaggttggagtgatgagtcaatgagtaaaggaatgccaggggttgctagcaactgccagaggctggaagaggcaggcaaggattcttccttcaaggcttcagagggagcatggtccagcccacacctttatttcagacacctagcctcaagaactgtgagagaatgcattggttttacaacaaacagttgtaaaactgtgagaggatgtgtttgttttacaacaaacagttacccagttggtggcactgttacagtagctctcagaaattaatacgctgagtacaaagtnaaaagctaattaggaatagacatggacactgatatggtttggatttgtgtccccactcaaatctcatgttgaattttaatcccctagtattggaggaggtgcatggtgagaggtgattggatcatgggggcagacttgctccttgctgttgtcgtgatagtgagttcttagcgagatctggttgtttaaaagtgtgtagcactccctcttcgctctcttcctcctgctccaaccatgtggacgtgcctccttcctcttcaccttgtgccctgattttaagcttcctgaggcctccccagccatgcttcctgtacggcctgtggaaccgtgagccaattaaacttcttttctttaccc

SEQ ID NO: 347123 - DNA, 911 bp, Homo sapiens
gggacgcccatggaacgcagcgaaggactatggcaggggagaacttcgctacgccgttccacgggcacgtgggccgcggcgccttcagcgacgtgtacgagcccgcggaggacacgtttctgcttttggacgcgctcgaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttca

SEQ ID NO: 347124 - DNA, 264 bp, Homo sapiens
actttgtaaagaaggaatgggtagtgtcagctaaaggaaatggtgtgcatcccagcaaaagaaagagaccgaaagcaaagtcataaaccatgcccacgagctcagctgtcctgctccgtgtcctctccatacccttgttgactgtgctcatattagccagagacctaagtgctcttggaggatgtccctggggccccctccccctccgctgtcactgtctacttcctgatcctctcttctgtgcaggagaggtccaggccttct

SEQ ID NO: 347125 - DNA, 257 bp, Homo sapiens
aggatagtcaggggcactggccacctgttttgattcttcttctaagagacagacttgtttctcagtttaaatataactcgaggccaggcgtggtggctcatgcctgtaatcccagcactttggcaggtcgaggcaggcggattgcttgaagtcaggagttcgagaccagcttggccaaaatggtgaaaccctgtctctactaaaaatacaaaaattagttgggtgtggtggcacacacctgtaatcccagctattcg

SEQ ID NO: 347126 - DNA, 477 bp, Homo sapiens
agtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacatcatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgta

SEQ ID NO: 347127 - DNA, 890 bp, Homo sapiens
ggcctcccaaggtgctgggattacaggcatgagccaccgcaccttgcaggtttttttaagttttagatgcaaagtaaaattgtcagccagctctaagatctttggtaatacttgattatttatctagagtttatcttgagttaatttctctttttttttttttagtgtttagctaaaagttgtattttattcagtgtatttaaagatataaaataatactttttgcattgtctaatctggttacttaaaacaagcaaaaaaaaatcttgtgtacaaatattcccttaaatgtggatatatatgctcttctttttccctttgttactcaaaatagagtttgagttatttttgttttgttttttgtaacccatgtggggcatatctttcccccatacccatgaaatattcatattaaggtttataaaagactataactttaacataatttttatctcatttccataggaagaagaatattagctcgcttgaggtaggattttataccataaagctcaagagttcaggttctaaaaccagacagactgggtttcagttctctaccgtgtcttagtttgaccttaaccaagtcacatagcctaagcccctcttttctcatttgtttaaatgatctgagtagcacctgttacatagtaaacattcagtaaatgttagctgctaaactataataatcaccacaacatatgtctctcactaccatatagtttttttctaaaaataactttaagtttaaaaaataattttactaggccaggtgtggtggctcacacctgtaatcccagcactttgagaggctgaggcaggaggatcacttgagcccaggagttcaagatcagcttgggcaatatagtgagacctcgtctctaccaaaa

SEQ ID NO: 347128 - DNA, 713 bp, Homo sapiens
ttgagaccctctcccgccttgggtgacagagcgagactccacctcaaaaaacaacaacaacaacaaaaaacccagaacattatcatggaaagtttaacaacatgattaacttctgatcctggagagtggtaatgatagactggatcaggagtctactggcctgggcaatagaaatgaaatctggactgtctcagggcttcgtataatcaccagcttttgtgggtggggatgttggggtgtcctacaggggtatcttgattccttctgagaacagatcatttctttgtcctttctgatgtcctaatctaaaacatccagtactcctggaggatttgaacttgtgcccaatggctggtcagactctcttggattgagaatgttggattgccattcctcagactgaatgtgggccaagcaattgtgctttagaaatttatcttagagtctgggtgcggtggctcatacctgtaatcccagcactttgggaggttgaggcgggtggatcacctgaggttgggagttcgagaccaagtctggccaacgtggtgaaaccctgtctctactaaaaatacaaaaaaaaaaaaattagctgggcatggtggtgggcacctgtaactccagctgcttgggaggctgaggcaggagaaactgggaggtggaggttgcagtgagccgagatcgcgccactgcacgccagcctgggcaacaagtgc

SEQ ID NO: 347129 - DNA, 817 bp, Homo sapiens
acaaagaatccctacaaatcagtttttaaaagtcatcagagcagcaagagatatgaattttaatggccaataaatccacatcaaaaggctctaactactagtgttgagaagctacagattccttatcatgctttatgagatcctgaaagatctggtttctttccatctccttaaactcatctcataatattgtttcctctcatttaccatacttaagttcaacctacctcatttccattttcaaatatgctgaccgctttcctattttctgcctgaaacaacttatcctggcatttaaaaaatttgtttcacagcgtgatctgtaatcattttattcgtttgtttacgtcttcattttctgtttctcatttgaagctacatgaagttagggactttatctgtcttattttccactctatcctcagtaccttgctcggtgcttggaacatattaggaactcaaaatatgagatgataacagtgcctattattgattactgagagaactgttagacatttagttgaagattttctacacaggaactgagaataggagattatgtttggccctcatattctctcctatcctccttgcctcattctatgtctaatatattctcaatcaaataaggttagcataatcaggaaatcgaccaaataccaatataaaaccagatgtctatccttaagattttcaaatagaaaacaaattaacagactatacactagttgaaagtaattgtttatactgattataatggttgggtccttttgaaatgagaaaattcaataaacgtgactttgatttttttatgtgg

SEQ ID NO: 347130 - DNA, 408 bp, Homo sapiens
gaaataacatttcgattgtgataaattcagaaaatatagtctttatatccttcattttctgcctttcaaagttgttaatagtttcctccagatgacgacttgttcggctagcatccattgcagctctctgtaattccgtttctgcctgtgaaataacatgtcgatcagatgggtttcgctgacgtgttctttctaactgagttaattgcttagcttctccttccaacatctcatgactccttccaatatcacatcatctcctttccaactatctcatccccccttccaatatcacatcgcgttcgcacgcgtcttgggactatgatgtgtggatgggcggtgatgacatggggagagatgttgtgaagggtgtctctcctgtttaggagtgggactatcctgtatcca

SEQ ID NO: 347131 - DNA, 271 bp, Homo sapiens
gaaataacatttcgattgtgataaattcagaaaatatagtctttatatccttcattttctgcctttcaaagttgttaatagtttcctccagatgacgacttgttcggctagcatccattgcagctctctgtaattccgtttctgcctgtgaaataacatgtcgatcagatgggtttcgctgacgtgttctttctaactgagttaattgcttagcttctcgattccttgctgtgaatgttgctttgaggtcatcccgtttcattttcacaat

SEQ ID NO: 347132 - DNA, 406 bp, Homo sapiens
ataactttatttgatgatctgacgatcagcgattagttctcatccacattgactgtctgtagatttttgaaagtggtaacaggtacataggtaaccaaagtatatagcttatttggtgaatcttcatcctcattacgttttctggacagcctcacatggattcggtataggacattccttattcctttggcccagacagctttgttgagcctggtgtcaatgcgcacatctggagttcccatctccttcatggcaaatttccgaatctctttgagtgcccaaggtgcacgtttcttgaagcccactccatggatgcgcttgtgaatgttgatggtatattctcgggttaccacttcgttgatggcaacggcccgttttcttctcgccacccttctttgcgggaacc

SEQ ID NO: 347133 - DNA, 367 bp, Homo sapiens
cggcacgagggtagaaactggaagctgttcagtgcactggcagctgaaccctgctcctgctccgtttatcagagttactatcatctcagataatatggagctcatgtcagcagtgcaggtggtgagtgcgcagagacaatctggaaggaaacgctgatctgaacagcagtaatcctgggggacatgggggtgggactggattacagaggactcattttctaaatcatgtattttatgatacttgaatttttttgaaatgggcatttatttaatgacatgttataatgtactttttttttaaagaagtgtaatatttgaatttttacatttgttgtgtaatcagcagaagcaataaagatttttcaga

SEQ ID NO: 347134 - DNA, 658 bp, Homo sapiens
gtattctttgttctgaatgggttgcctagaaactccttttttccctttgatgcctaggggagtaaagaaaacaaaaaagagttaagaatattctttaattttggtatattccagtttagcattatagctgatatatttacagctagagtatcttttaatatctataatcaggacagagacataattatgaaaatccacaaaacttgataaagtgagaatctaactgcccagatgatagtggtttctactacaaagcaagcctccatgaattcattcacacctgaggtttattaaatatgtgaccccaggcgggttactttacctcaattgcatacttttctcctcatctgaaaagtgggttcataggattataaagactaattgcgataacatgcagagtgcatggcatgatatttggtgccttgtcaaagcttgataaacagggtccagtctaagaaacattagggagacctcttctctacaaaaaatttaaaaaattattagctgagtctgatggcacatgcctgtggtcccagctattcaggaggctgaggcgggaggattgctggggcccaggaggtcaaagctgcagtgagccatgattttgccactgcattgtagcctgggcgacagagcaaggccctgtctcaaaaaaaaa

SEQ ID NO: 347135 - DNA, 338 bp, Homo sapiens
gctggcagcacactggctgcagagctggcatggccactgcctgtttgtttgtctgcaaggagagtgggaagtagcggggagggtgaccataaccttagcaacctgaagccaagggtgaacccttgctcagatcttgcattttaagagtaaccaaagggttctgaaacatattccctttttaaatctctgctgtgcagtagcgaaggcccctttgaatgtatctttctttccagagtcaaccagaggcaaagccagattgagggttcccaggctgacaaatgtctgctgcctctgccacaggagagagaaggggaaagagggcaaaagaaacaaagaca

SEQ ID NO: 347136 - DNA, 755 bp, Homo sapiens
ctccaggggagaaaggagggcacagtgcccaaggccatgccagggcaaggacgggccactggcccccgccggccgagtcaaccagaggcaaagccagattgagggttcccaggctgacaaatgtctgctgcctctgccacaggagagagaaggggaaagagggcaaaagaaacaaagacatcacgcgttgcaagtggctggacttttaaaaacctacctttgcctccagggttttctaggttactgtcaccccacttcctaaaaagtgtctcccccctcatcctatttaagacctgatgcagtctccccactggttctcccagggaaagaaaaggggaaatgttttgttgaaaataaaagggatgacaagaaagaaaggaaaaaaagctattgttttcatccctaatttataatccaagaggcccccaattgtttctttctgactcaaatctttgagctgttaattataaaagtaactggacttggcgccaacgggctaactatgatcaggctcagcaattagaaaaactctgtagaaagtttactgagtgattatatataattaattcctagttacagactgaacactgaccattttctggagctaataaaagcagttactccccctcccccacgtgaatgccacttaatttcccaaagcagaaagtgaatccatcctggagggtcttgaaggaaaaaaaaggagaggaatcaaaagcttcagtgtgtctgtgtttgctccttgcagctgtgta

SEQ ID NO: 347137 - DNA, 228 bp, Homo sapiens
caagaagctcaacaaaattcaagcagaatcaactcaaagatcaataccaaaacacattataatcaaaaccaaatgacaaagagagaatctttaacagaaagtaagaagtattttgtcatgtagaagggatcctcaatatattaacagatattctcattagtaatccatgtagaagggatcctcagtatgttaacagatacttttctcattagtaatcattgaggccag

SEQ ID NO: 347138 - DNA, 466 bp, Homo sapiens
cgatttcccctcttgtctgctgagccagcaggggccacgtcctgggctgctgtgaggaggaagtgagttggtgctaggaggggctcctgtgtgtgcatgggcgggaggggtgcaggtatctgagcaccccggtctccacttgagagagcagggcaggagctccctgacccacccagactacacacgctgtgtccacgtgtctcacattatctgtggcagaggatccggcttctttctcaatttccagttcttcacaaagcaatgcctttgtaaaatgcaataagaaatactagaaaaatgatatgaacagaaagacacgccgattttttgttattagatgtaacagaccatggccccatgaaatgatcccggaccagatccgtccacacccgccactcagcagctctggccgagctcacagtacaaccacaataaactcttgttgaatgaactctaaaaaatctgt

SEQ ID NO: 347139 - DNA, 507 bp, Homo sapiens
  misc_feature (272)..(272): n is a, c, g, or t
  misc_feature (335)..(335): n is a, c, g, or t
  misc_feature (353)..(353): n is a, c, g, or t
cgatttcccctcttgtctgctgagccagcaggggccacgtcctgggctgctgtgaggaggaagtgagttggtgctaggaggggctcctgtgtgtgcatgggcgggaggggtgcaggtatctgagcaccccggtctccacttgagagagcagggcaggagctccctgacccacccagactacacacgctgtgtccacgtgtctcacattatctgtggcagaggatccggcttaaaaaacggcggggcggggccccctacatcgtttgcggccncaaaaacacccccccgctttacatcggcgcggccccccccccccctttggggggaaaaggggncccggttccccgcgggtncccccctttttgggaaaccagcggcgtccgcaagcctgagccgggcatttgagaccgggccggagccgctgccgtgctgaagcttggagcgcccgcccgggtcgcccataaccatcccgcgtttccagcatccgccgccgccccgggcctggct

SEQ ID NO: 347140 - DNA, 608 bp, Homo sapiens
tgcaaaaccaaataggaatattatttaaaattaggactacagtagcctaacagatcctgcattacaacagcaacatgaatgttatgactataatttataaatagttccagtgtttcttaaattccttaagactttacaaaataaaaattttacactattgataatttatattttacttttctgtaatggagggaaaaataaagatacctccaaggtttaaccagaaatctgttttcaattgcagtgaaatcagatttagatactgcattaggataaaagagcttcctgtctcaaaatgcaaagccatttagtaatttttgaaaatagggctttttcccctcacatgcacagttgttctttttcaaatacatacttgcaaagtaagtataggaaaatgtcaaccttctgccacattcaaccatccttaattttaaagttttcctcttttcacatgtcagttaacttacagtacataaaaacttattgtaggatttatttttcttttatatttttacctggttaagtcattttatacatttttttctaggatggagagcataagccattcactattgtgttagaaagagaaaatgacactttgggattca

SEQ ID NO: 347141 - DNA, 853 bp, Homo sapiens
tccctaacatgggctttgccctggagcgcttcgcagaagccgtggacccggctctggagtgcaaactgtgcggccaggtgcttgaagagcccctgtgcacgccgtgcgggcacgtcttctgcgccagctgcctgttgccctgggcggtgcggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggatggagagcataagccattcactattgtgttagaaagagaaaatgacactttgggattcaatattataggaggtcgaccaaatcagaataatcaggaaggaacatcgactgaaggaatttacgtttcaaaaattttagaaaatggacctgctgacagagcagatggcctggagattcatgacaaaatcatggaggt

SEQ ID NO: 347142 - DNA, 269 bp, Homo sapiens
tggctgcttgggactgaggccagctacaggagtagggagggacacagggaccaagggagggggaagcttgggagtctcttctgctacttgcctgcccattgcagggggatgagtattttttcttcttcatctctttccctgccacccacttgagctgctgtgagggcacctttcttctaggggctcacttagctccctgaggtctgaccttggctgcagggaggggctggcaggcctggcaaggttagggttcaaagcacttttcccat

SEQ ID NO: 347143 - DNA, 544 bp, Homo sapiens
gcagagctctgcaaggagaggttgtgtcttcgttctttccgccatcttcgttctttccaacatcttcgttctttctcactgaccgagactcagccggtagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 347144 - DNA, 674 bp, Homo sapiens
gcagagctctgcaaggagaggttgtgtcttcgttctttccgccatcttcgttctttccaacatcttcgttctttctcactgaccgagactcagccggtagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaaaaaaaaaacacaaaacctagagcactagtgccccccttggggagccgcggctaaggggcgccaaactttggcccaagtcccaagaaccacccaacaacaacaaacccggtccccaaaggggcaccaaaat

SEQ ID NO: 347145 - DNA, 739 bp, Homo sapiens
gcagagctctgcaaggagaggttgtgtcttcgttctttccgccatcttcgttctttccaacatcttcgttctttctcactgaccgagactcagccggtaggtctgcagagtggtcttcctggtaatttagttgtgagtgaatgtgtggaggagccagcgggcttaggacaggtcctgtggcacagtccgtggctttgagggaaaagggcctcgcggtggtcctccgccttcccccaggtcgtgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 347146 - DNA, 794 bp, Homo sapiens
gcagagctctgcaaggagaggttgtgtcttcgttctttccgccatcttcgttctttccaacatcttcgttctttctcactgaccgagactcagccggtaggtctgcagagtggtcttcctggtaatttagttgtgagtgaatgtgtggaggagccagcgggcttaggacaggtcctgtggcacagtccgtggctttgagggaaaagggcctcgcggtggtcctccgccttcccccaggtcgtgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaaacaaaaaaacccggctctttcggtcgggaaaaggttgaatggctggaagttccga

SEQ ID NO: 347147 - DNA, 739 bp, Homo sapiens
tgtgtgtcggatgcatatccgactctgtcggtccttcctcaaacattcattcgtacttaacctcacgagaacgaaagtcaaccggtatgattctgaatcagtctgcagagtggtcttcctggtaatttagttgtgagtgaatgtgtggaggagccagcgggcttaggacaggtcctgtggcacagtccgtggctttgagggaaaagggcctcgcggtggtcctccgccttcccccaggtcgtgatgcaggcgccatgggccggtaatcgtggctgggctggaacgagggaggaagtgagagatatgagtgagcatgtaacaagatcccaatcctcagaaagaggaaatgaccaagagtcttcccagccagttggacctgtgattgtccagcagcccactgaggaaaaacgtcaagaagaggaaccaccaactgataatcagggtattgcacctagtggggagatcaaaaatgaaggagcacctgctgttcaagggactgatgtggaagcttttcaacaggaactggctctgcttaagatagaggatgcacctggagatggtcctgatgtcagggaggggactctgcccacttttgatcccactaaagtgctggaagcaggtgaagggcaactataggtttaaaccaagacaaatgaagactgaaaccaagaatattgttcttatgctggaaatttgactgctaacattctcttaataaagttttacagttttctgcaaa

SEQ ID NO: 347148 - DNA, 1496 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347149 - DNA, 1562 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347150 - DNA, 1882 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccattctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347151 - DNA, 1524 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccattctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347152 - DNA, 2134 bp, Homo sapiens
  misc_feature (1921)..(1921): n is a, c, g, or t
  misc_feature (1923)..(1923): n is a, c, g, or t
  misc_feature (1934)..(1934): n is a, c, g, or t
  misc_feature (1936)..(1936): n is a, c, g, or t
  misc_feature (1938)..(1938): n is a, c, g, or t
  misc_feature (1947)..(1947): n is a, c, g, or t
  misc_feature (1949)..(1949): n is a, c, g, or t
  misc_feature (2134)..(2134): n is a, c, g, or t
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaananaaaaaaaaaanananaaaaaaaananaaaaaaaaaaaaaaattggggggctttttttggggggggggagaaaaaggcggtattaaaatggggatgtggtctattttgtttctgtgacccactttttttgtcaaaaggggggaagattcgggggggccccaataaaggggggggataaatcgagaacccggttccgtcttttggtagacaan

SEQ ID NO: 347153 - DNA, 1752 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctatacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347154 - DNA, 1396 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagtctccacctatgtacagcgaacacctcaacagatggcatgtgactcgaccagtatgctcctagcttgacaagattttggaaaatttcacagtaccttctccgctcggcgtcttgagggtctgtgcctggcaggctgatggtgatggaggatggggcacccacatcgtagcgcttcaccgtcttctggcatatctttaccttcaccaggaggctgtgcaccaagttcgccagcaaacccaccacaggctgcaggatctcagggaagaaagtggcgaaagcaaagtggtcagccatgtcccctcggccccggctatggcgctggtagaagcgaagatataccca

SEQ ID NO: 347155 - DNA, 1920 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347156 - DNA, 1143 bp, Homo sapiens
actacctgtgaagaataacaatatctgtaacatcctgcgctacggcttgtgtgcctagtggtaacttccgcttatcggggctatggcaacatctcggaacatatttgcactgccgcagaggccggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347157 - DNA, 1893 bp, Homo sapiens
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctatacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 347158 - DNA, 2284 bp, Homo sapiens
  misc_feature (1921)..(1921): n is a, c, g, or t
  misc_feature (1923)..(1923): n is a, c, g, or t
  misc_feature (1934)..(1934): n is a, c, g, or t
  misc_feature (1936)..(1936): n is a, c, g, or t
  misc_feature (1938)..(1938): n is a, c, g, or t
  misc_feature (1947)..(1947): n is a, c, g, or t
  misc_feature (1949)..(1949): n is a, c, g, or t
tcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaananaaaaaaaaaanananaaaaaaaananaaaaaaaaaaaaaaaaaaacaaaaaaaaggagggggggccgacaaaaagatcatcccccaggggggcgcccaagaagcacgagacaaacgcaagattggaaaacaagggggccaacaaagaggggagaggaaaattaaacaacgacgcgaggggaagaggcgccggggcgacgaacaaaaagagagagcagggcgaggaaaacggcgggacacgagaaggcaccacacagggaagcacggaaaacaacaacacagacagaggagggaggggaaatagcgggagaagacacaaacccacacggaaagacgaagagcccagaggaggagaaaaaaat

SEQ ID NO: 347159 - DNA, 336 bp, Homo sapiens
atttttgtttcaaattgccagctgcttatgtcagactgactcccttattatgcctccagtaggcctgtcaatatggccaaacagctagataagtgcggggcaggacaaagggctctttgcacagcagggaggcaatgttggtgggggaggggcaggaggtaggaaaggcaagaggaggaggttcttttccctgggagattattcagtttggcatacaattaaagaaatcatttttagttcccactcaagcattgaatttttgccaaccacatactattaaccccaaatttgatacatttcagaatatcttgtagggatccattctcgccaaggaaa

SEQ ID NO: 347160 - DNA, 314 bp, Homo sapiens
actcgttaaaaagaagtccaaaacctatatgagaaaaacgataacacactactgaaacacataaaagtagacttgaacaactgtaaagaaatatattcttatttaggcagattcagcatcataaaggagttagttctccctagattaatatataaatgattgcaatccaaaaaataaaaataccatcttttcttggaggggaggagtaggctagataacttaattttgaagttcattgggatgaagaaaaaaggaagaatatccaggaaaaatcctcaaaagagaagcaacttggagggaggggagaaccctat

SEQ ID NO: 347161 - DNA, 778 bp, Homo sapiens
aattttgctgttttcttggccacatccatccatgatggaattgcagttatacactttaatttgaaaggaacatttaaaattatatacgattccacctgtaaaatatcctgctgtaggattaatgcagcaagtctcacagaaactatcctgagcgatggactgtgtccaagggagcgtcacgagtaaggaaagtccagtctttgtggaggcacaccctgggctgaacattctttaattaacaaagacaaacatttcacctgtggcctgaacaactggaacaaagtttccaacggtggaaaaactaacaactactaaaaacctttaaaaaagaagactaacagcaacactccaaagtaagttggattctataatagttgcaggttgcaattggaggcaattccaagcaggaaaggttaggctttagtttatgcaaaggatagagaaactagcttcaaatgtgcatttttttccccctggctagcattttcctggagggagaattggtaatgtctcctccaaagctttcctcagttgaagaaatatgtaggaataggaatgtcaaggatgtaagcacgtgcaactaaaactccaatttgtaccgaggaaactgtattagttaaaggatttcattcttcagtagtgaaagtatggtgaaattattattgggatataaaacaaaattgacttgaatgagaatctagcttatcctccataaaaagcttagtgaaatagttttcaactctgttcaactgacaatgaaatctaggctttagctatt

SEQ ID NO: 347162 - DNA, 637 bp, Homo sapiens
gggcaaatgaagacagagaccactaggctgatacactgagtttgatatgaaatgttaattaccattaaaacttttttattgaggcatgatcaaatctgtagtttacaaagattactctggttgtaacattctgggagaaaataaaattattcagtctgagaaagactccatagaacaagtgatattttagctgggtctattcatctcacaggatgaatagaagcttttttgaggaagggctctgcagaatgatgaaataaaatgaaaaaagatatgaaaacataacagggcaccacagattctaggacaagtaagagggccagagtggttggaaaacaggttatttagagaaagaggtatcagatttgaaagacaggcttaggctttgttatgaggaacactacagtttcccatttaattacaaattttgtcattttataagatgggaaattcccctttttccttatagacagtcataacatcaagtgatgggtgattcaacaattattcatgatgacagtgccaacatccctgctcatatattaaatgagacactacctgaagtagataaagtatccacaatttcacttcagaatatttggctgctatgccaaagagacaaccacttatagttgtc

SEQ ID NO: 347163 - DNA, 513 bp, Homo sapiens
tttttttagagacagggtctcgctctgccacccaggctggagcacagtggtgagatcattgctcactgcagcctcaacctcctgggctcaagcaatcctcctacttcagcctcctgagtaactgagactgcaggagacatgctcaccccgatcgcttccaccagctcaggctgcatggtttcaacaagaggaatttgtttctcatagttctggaggctggaattccaagatcaagcagggcctatgaccatgtctgatgttcagggaatgaagaagtgaagaaagcaggaatgaatgaaggaaggaagcagccccagcaattggttcccaggcgagaagctggtggggttctgacttctatcccgattcacacccttttctcctgccctcagggcggtccttctcctgctcttgttcattcatccccttcagccctttcgtattctcttctgtagccgaaccacaaaaaataaatacattagaaatgttttccgagctcatcagatgcatcat

SEQ ID NO: 347164 - DNA, 723 bp, Homo sapiens
cctccaaagtccccccctccaaataccatcacgctgggtgttaggacttcaatatacaaatttgagagggagacaattctgtccatagcaggcccctggggtccccagccagagtaaccccacagaagctaccagtaaatctccaaagccatcaccatagcccaccgaacatttcacctctgcctgcgttctgagagtgggacttgttcattgttctgttttaattctcagcagggcctatgaccatgtctgatgttcagggaatgaagaagtgaagaaagcaggaatgaatgaaggaaggaagcagccccagcaattggttcccaggcgagaagctggtggggttctgacttctatcccgattcacacccttttctcctgccctcagggcggtccttctcctgctcttgttcattcatccccttcagccctttcgtattctcttctgtagccgaaccacaaaaaataaatacattagaaatgttttccgagctcatcagatgcatcataaggccaggtgggcctgccctgtcactgctagccatgggtagacatttacatttaaagtgacaagaattaaatacaatttaaaattcagctccttagctgcaccagctgcatttccagagctcgacagtcacgtgtgactcgtggccaccttactggacagtgcggatctagaatgttctgccattgcaggaagtttggacaactgcaatagcc

SEQ ID NO: 347165 - DNA, 556 bp, Homo sapiens
ctatgaccatgtctgatgttcagggaatgaagaagtgaagaaagcaggaatgaatgaaggaaggaagcagccccagcaattggttcccaggcgagaagctggtggggttctgacttctatcccgattcacacccttttctcctgccctcagggcggtccttctcctgctcttgttcattcatccccttcagccctttcgtattctcttctgtagccgaaccacaaaaaataaatacattagaaatgttttccgagctcatcagatgcatcatgtctatttctctgccccagcccagtggggtgggtgatgcctttgcagcccccacttgccaggggcaccttgtgggcatctagatctccagacctcaaagccagcacccacccaactgcagggtgctgtctgcgctgtacgcattctgagagctccgtggcctgggccagccccagctggaacctcgggtgcccttcactcttccaaaagaggctgtttgctttcaaagaaaggaaagagtagaactgcagactgcatttggctacacagcctgagactcctggg

SEQ ID NO: 347166 - DNA, 886 bp, Homo sapiens
gccctgtgtaattacctccacaatcaacagcctctctactgtgccatcatggtaacacttctattttatggccacacccatcccctctcctccatccctaagccttgacaactgttactctgttctttatctctataattttgtaatttcacagatgttttttaaatggaatcatatggcatgtattctttaaagactggctttttttttctcacgcagcataaactgtagataccagtattctgatcctttttaatgctaaatagtcatccacggtacggatgtgccaaaattttgtcttacgattcatgccctgaaggatgtttggggagtttccaatttgaggctgttaataaggctgctatgaacatttgtgtacaagttcctgtgttaaaaagagattaagttctcgtgatgtatgtcttaaaattcatttgcgcttaagtatgaaaaaaagtcatcagattgtagagggagtttgacagctatagagagaaaacccaattagaacttagtaacagtggctaaggttgtttttcagcaagtatgatctttaaccaacatcatgggtcataagagatttcaaccattgcaagctgtatgttaaagccttcactaatcccactggcttttatactgattttgttctatccgtcttattctagagttaacgtttctgccaggaccagttgtgtagcagtatgtcctatttcttagttctttaaaggcaataactcagccataaaagccagcaggagagtacttcactgacaaattggttggccagtcttgtgtatgtgcattaaatcgttgggagcaaataggaaagaggaagagtgggagcaaagcctcttccggtttgcttttaaatgttaaaaaaaaaaaa

SEQ ID NO: 347167 - DNA, 264 bp, Homo sapiens
cattggatgactggcctccatcacaggtgacttgagtacttcattggtttgtgccattagcccagtcttctcaatgcctttcccccagacttcaacccaggaagaataccttttgttccactcttctccccatctgaaagtgtttttgctctttattaaaaccacgacagtggtatatgctaggatctccttggagacccaaagaatcctgggactttcagacatcaccagcagagcatcctgctgcttctcaaccaactggaa

SEQ ID NO: 347168 - DNA, 420 bp, Homo sapiens
atatggcatgatgccattctcttttaaaaacaaaacaaataacactattttatatgtgtgtatgtttgtatgagcagagaaaaaggtgtggagggagctattaccacttaaggagacggcactggagaaggtggatgaagatcagccttttctttatctgcgtttgaaatatttaacttgtaataaccgacatttttttggtaactttaaatctaataaagtacaaccaaaaaaagcaatgtgctatgaaaaactgcactgcaggccctgctattcccgcctgctgttattaacccagcagtagccgtatctgcagataagaaagaggatgtggtcgtctcaagtctctggaggcaccagggtccaagactggtcctcagctttgtagccaatgttcttgctttctcttttcatattgaa

SEQ ID NO: 347169 - DNA, 299 bp, Homo sapiens
tctttaaaaaacagcaacaacaacaacaacaacaacaacacaagagttaaatcggtaaaagaatgactgaaaagaaattctaatagccaggcgtgggtggctcatgcctgtaatcccagcactttgggagcctgaggcaggcaaatcttttgagtccaaggagttccagaccagcctgggcaacatggcaaaactctgtctctaccaaaaaaaaaagaaataacgaaaattacccaagcgtggtggcacatgactgtggtcccgactactcggaaggctgagatgggagaatcacttga

SEQ ID NO: 347170 - DNA, 231 bp, Homo sapiens
ggggtgtagctgagtgtagttctgagaagcggatggcatctgaggtggggttgggcaggctgagggctgttttcctggttcctgctgaggctcatcccctgctaattgtcttctccaaattatcctgttactgcatggctatgcattagctctttgtttgcctacaacacatatgtgacactgatcccaaggacaaaggaatcatgctgactttatttgcaggaagaccgt

SEQ ID NO: 347171 - DNA, 155 bp, Homo sapiens
agcaaaataataaataaatacataaaatagatttatcagtttatcaataatatagttttcttttctaggtgtaaatataggtaatgactgtcctttagtacattttctcatgatgctcctcttacttggtttggtacaatattaagtattgaaat

SEQ ID NO: 347172 - DNA, 2374 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttggtaaggactcgggtcggcgccagtcggaggattgggacccccccggatttccccgacaggtcccccagacattccctcaggctggctcttctacgacagccagcctccctcttctggatcagagttttaaatcccagacagaggcttgggactggatgggagagaaggtttgcgaggtgggtccctggggagtcctgttggaggcgtggggccgggaccgcacagggaagtcccgaggcccctctagccccagaaccagagaaggccttggagacttccctgctgtggcccgaggctcaggaagttttggagtttgggtctgcttagggcttcgagcagccttgcactgagaactctggtagggacctcgagtaatccactcccttttggggactgacgtgaggctcccggtggggaaggagactgacctctcggttcacgtgtcttgccatagagccactctcctgagtgggtttttctcctgatcgtttgggccaagtgacttctctctgaacctcatatttctcttctgggataataaatggtcaccctttcaaggggttgttttggaagatattgtgaacaatggtaaataagggcttaattaatgagggtaagccctcagtaaattgtcactgtgtgttcatttcttcctctgtgtggatcgtgaccgagagcccttccccctagcctcctcctggtatgggtacccaaaacctaggtgagcagggatctctcccaggggcagagagcttgtgtactctgggtgttagagggctaaaatataaccagtcaacaccacgttgcccatttctggtacttccggtagcagcctgagtctcaattatcttgcccagatgatctgaactctgacctctagcctgtttcagcataggcagagagcttgagtaggtgagtttgcattcctcatagcagctggctgagcctagtctggacttctctttgacctgtaacctacaggcccacaggcccaaggcaaccacaggttgcttccagggttaccacacaggtggtttctcatttctaatgctaggttttagataattgttgtaagtgaggggccctggcaggcaggatgacatcctgccaataggagttttctgtcactttcccacagagccctggctactacatactcttgctcaatttcgccagtaattgcgtcaatgtgttcatatcaagtttgggaagaacatcttggaattggtcagacgtgaactgtggtaataatgggggcttgtttttttaagcagataattaaattcctttgcatttgatgattattctgggaagcagactagtcccataaaatgaaatggactctgccttgctgctaagtgtctgacttgagacatgctatcgagtttctcaaaatctcttccttgtgtaaaatgtggttgtcgatgattaccttacaggggttttttttaagactaaatgagatcgtgtacattaaatacaggcactcaggctgggcatggtcgctcacgcctgtaatcctagcactttgggaggctgaggggagtggatcacttgaggttaggagtttgagaccagcctggccaatatggtgaaacaccatcccatctctacaaaaatacaaaaaagttagccaggggtggtggcatcgcagctactcaggaggccgaggcaggagaattgcttgaacctgggaggcagaggttgcagtgagtcaagattgtgccagtacactccagcctgggcgacgaagcaagactgtctaaaa

SEQ ID NO: 347173 - DNA, 4232 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaaaaaaaaaaaaaaaaaaaaaaaaaaaaaaaaa

SEQ ID NO: 347174 - DNA, 3737 bp, Homo sapiens
gggaagcacgcaaagtcttctttcaaacaattcttgctgcaaatcaaagagttaagtaatccaattgacttagactcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaa

SEQ ID NO: 347175 - DNA, 4178 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttgatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaaaaaaaaaaaaaaaaaaaaaaaaaaaaaaaaa

SEQ ID NO: 347176 - DNA, 3122 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagagcacccactcctctctgttcaggctgcgcctccaacctgtagcacagcctgacactcctgcgacaccccacaatgccacctctcaggttgcagacgtttctatctacctgaccgcacgctctgccatcaggccatttctcatttgtctatatatctcaacgcactccacactgtgatccacacacaacaccagcacgaacaacc

SEQ ID NO: 347177 - DNA, 3890 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaa

SEQ ID NO: 347178 - DNA, 2972 bp, Homo sapiens
tcaggatccccccttaatatttctggcacgtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaa

SEQ ID NO: 347179 - DNA, 514 bp, Homo sapiens
cggaatacaccgcgcaacctatgaaccttccctctacacttatcatcttcacgattctaattctactgactatcctagaaatcgctgtgccagcgagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaa

SEQ ID NO: 347180 - DNA, 1108 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggtgaggcctgggaaggtggaatgagagagggtgtgtgtgcatgcagatgtgtatcagatgtgtgtgtaatgagggcaggggaaggggagtgatttcacagacacctggcacttacagcgaggaaccagccccccagccaccaccagtgcagatgaggtaaacgccaaacagtgtgcttgcctattgctgtcaactctatagccaagggaaatgctggagtgttttcgttgttctgtttttgttttctggaagtagccttccagcaa

SEQ ID NO: 347181 - DNA, 990 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccagtatgaaaaaataagaagactcctgtggtgaaggcttcgcctggtctgttctgctctggaggtggcagcgcatggtggttagtcccagcatcttcctggagatttgagcgtgagacgtgctggctgtgtgggctgtgccacctgaggag

SEQ ID NO: 347182 - DNA, 4201 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaa

SEQ ID NO: 347183 - DNA, 4261 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaaaaaaaaaaacaaaacaaaacaaaaaacacaaaaaaaaaaaaaaaaaaaaaaaaaaaaaaa

SEQ ID NO: 347184 - DNA, 4074 bp, Homo sapiens
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggagagagagcattgcatagggagggccccctcctttcatgaaacagagctctgttgtgatgtgtattttgttttgtt

SEQ ID NO: 347185 - DNA, 4687 bp, Homo sapiens
  misc_feature (3706)..(3706): n is a, c, g, or t
  misc_feature (4062)..(4062): n is a, c, g, or t
cgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcacccaagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttgggggtaacctttctcattctcagtgttcaagtttgtggggtctcatctctttagaaaccaggggaaaatacgggctctcccgcgaatttggcgtgacgttagtgtggcctcctcaaggggngcctccacgcgggggcccagagggccacgagccgaagggcacgagttagagggcgcgtggaagtgttttggccgggggctcgcgggaagaagtgccggagaggtctccggtgtttcccttaaagggggggggtaattccgaggggcccgtgggggctcacgaggggagagccattttctcccattttccgcggggggagtatttagtggacgcgggacaaaaagtttgtgtctcagtgtgtggccgcggggggccccttttcgcgtgggttcccgtggggtataactcccctgatgtggggcgggggatgacaccccttgtgtgtgtgtgaacacgcggtggggcccttgtggggngaaaaagagatacccgagagaagaaaggggccccagagagcgtgtggcggcccacggaggggacacaagagtctcaagagggagaagatatcggcgtgtggtcgacgtgtgcggcactttcttcagaaagcctggtgggaccaccggaggggggcctccctctggtgggtgttgaaactgtcggcccagaaggggggcgccggggggggggggactctctgtggcaataattaagcccccggagggagaattgagcagcggggctgcttctcacacgaagtgtgctcccccgagtagaaagacaccctcggtggtgtgtagggccgcccgagggaggaataaaatttaggaggagcaagtacttcccgtcgttggtgtttatgttggaccccaacatggtggtgttgggttgctcttttcttttcaccccaccatgctgtgtcgttgtttacgggcgggaggaagcaacgtagtgtgagcatatcggaagacactccctgggggggcgggcttcaccaaacaagagcagaagaacaccgcgtggggtctattttgtgggcggccgccttttataacacaatcgtttaaatatataattatattaagcaagcggcgggaaaaactt

SEQ ID NO: 347186 - DNA, 1497 bp, Homo sapiens
  misc_feature (27)..(27): n is a, c, g, or t
tcgctattcatcggcacctcgctattnatcggcacctcgctattcatcggcacctcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaa

SEQ ID NO: 347187 - DNA, 3911 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttc

SEQ ID NO: 347188 - DNA, 4727 bp, Homo sapiens
  misc_feature (18)..(18): n is a, c, g, or t
taacacagttgtgaaaanagatggatgtgggttccagtcctagccctgcctgtgtgcacttatgcagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 347189 - DNA, 2679 bp, Homo sapiens
  misc_feature (81)..(81): n is a, c, g, or t
cactcatatggcgttgacatccaagtatcactgaggttggacccagacaaccttagatattacgagttcatgagatgctcntgatccttttccgcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 347190 - DNA, 2493 bp, Homo sapiens
gcttctccccttgtacctctgcccatcgcgactgcaaatcaggaagggacgcagtgtgtttgaacctccctgattgatgagggtccaagttttctgtcagtagcatagagggctgagtggcctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 347191 - DNA, 1810 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagt

SEQ ID NO: 347192 - DNA, 726 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcacggggacctcgttaagctt

SEQ ID NO: 347193 - DNA, 800 bp, Homo sapiens
ctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggtaagggccagggtggggcacgtgcccctgcaaatgcatagaactggtcttggctgcagactcgggctgcagacttgggcctggcctctgaagcttagagctgaccatgaggcactctagggccagggtttccaaaccagcaaccatcgttcagcttcttagagggaggcacttgaatatagcactttctgaaaacgatccgcgcacatgccgcaggtggtataccagataatctgggttggcacaggataaaggttttttgtttacatcatcatatgagtatgtcaagtggtgtcaatttcttcctttacaaaggtgatatggttccccttttaagaaaacgtatgttatagtaagtaacatttatatattaataagttaacatattttgagcttttactctgtcagtatagaccagacaatgctgaagtgaccaaacaat

SEQ ID NO: 347194 - DNA, 4746 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 347195 - DNA, 4004 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttc

SEQ ID NO: 347196 - DNA, 4183 bp, Homo sapiens
gagaccatgacacagccaagctgggataggtgagggaagattgctgggagccctagacagctcacggacaagaaactagggagccctgacagaattagaactcccacgttggggcctggagacttcaaacccttcaagagatgagattttccagcagtggtgctgcatggcccctccgcgaggctgtgtggcccctccgtgaggctgcgtggctcgtgacctctctgagtcttcatccagtttcctggtgactctccttgtcttctctctcaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 347197 - DNA, 1138 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgagagagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaatttatttactactgctctgttgattgacagatagattgcttgcagtatttcactatcttaaacaaatgctggggtga

SEQ ID NO: 347198 - DNA, 955 bp, Homo sapiens
gaattccgccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttctactgtaacggggacggcgagtggctggtgcccatcgggcgctgcatgtgcaaagcaggcttcgaggccgttgagaatggcaccgtctgccgagagagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaatttatttactactgctctgttgattgacagatagattgcttgcagtatttcactatcttaaacaaatgctggggtga

SEQ ID NO: 347199 - DNA, 991 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaatgtatgtatatgggataatttatttcagggtaatataataggtgtattacttttctactaaatattttagaaatctgaaatgcatttaaagtttcattttgtcatgagtactttttttaaaaattgaatatttaagactacgccttaaagttcttacaatatgatatggttgattgtgaaagattataacttccatatactctagtatttacctttgaaccctcaaattattgtaaatagtcaagtaaggaaatattttggctccattttttattcaatggacttttaacctgtttactaatcaccagatatt

SEQ ID NO: 347200 - DNA, 5950 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347201 - DNA, 5844 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347202 - DNA, 4334 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347203 - DNA, 4984 bp, Homo sapiens
catttaaaacttttctttagacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347204 - DNA, 4725 bp, Homo sapiens
taaccccttgcacttaccgggtgaggcaacaccccaccctgcttctgctcaccctccgtgggctacacccactgtctaaccagtcccagtgagatgaaccaggtatctcagctggaaatgcagaaatcacctgccttctctgttggtctccctgggagctgcagactggagctgttcctattcagccatcttgcctgggagccactgtgggcaaatcttaattggaagataatgtaaagagatacatattcatcttcttaaatattagaggtattttttattgttttctttctagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347205 - DNA, 1257 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcaaagaccccaaaaggggtaccgagct

SEQ ID NO: 347206 - DNA, 452 bp, Homo sapiens
gcttcatggaaaagagaacagtatgtaatactcgtcagttgaggacaagtattggataaagtttggaatttttatagaggaggagaagcactgggtgttagctatttctctattatgatatcatccccctttttttgtacaatatatttacctgaaaggaaggtttctattccttgggtgtggacttgggcaaaaaccaggttcctggaacttaaaactttgaaggtctgtcataggactctggacagccacacaccttagctattcccaggggaccccaggggggcaactgccattgctctaagatgtccttttgatgtgacttgagatataaatgagagtgagggcctgtacgtgtggctatttcctgtctggtatgtcagaggaacagtcctggtcagaagggggctcttctgagcagaaattgctaataaactttgtgctgatctgga

SEQ ID NO: 347207 - DNA, 723 bp, Homo sapiens
acgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccaggtgactggtcgctgcctctccaccggaggaaaaagtagggtgggagggcgggcttgtcctaaccaccctcacagcgcctcagtctgctccccaccagctcctcatgtggtttacctcccttggttgtgggtcacacgcttgctctgccactcctgcccccttttactgttttcctccggaccctccctgcctcctgccgcaccactgctcagcgcttctaactcggatttcctcatccctcctgacacatagctgctgactgtaatctctcaatctctct

SEQ ID NO: 347208 - DNA, 5988 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347209 - DNA, 4946 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtaatctgtaactgactgtcggggctgcatccccttttcaaagcggttatacattccactccaaaacctggaaaggatggcaaagcgtcgtgataccaccttatcacagtctgaaaattcacatcctcaagtcttctaaggtatctatgataccacagtcttaataataaccaaatgcaaatttcagcctcaaaaaagccactacttaaggtaata

SEQ ID NO: 347210 - DNA, 6021 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccaggctggagcgcagtggcgcgatctcggttcactgcaacctccgtctcccggattcaagcaatcatcctccctcagctccccacacccctccgagtagctgggattacagattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347211 - DNA, 5798 bp, Homo sapiens
cagaaactgactaggagcctgcgtgtgggggcgcggtgggcagtacggaatctgatgcatggtcagtatgctgggcgtctagggaccagtcctgggtgatgacctacctgtttcggagttcctcacacatttacacctacatcgacccggcggcgaacgcgacgtgtactgatacacacaatgaagattggaggagctggacggtcagtaacatggattactaagaaagacacggcagtccaacacgagttggatatcgagatgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347212 - DNA, 5242 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtccccctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347213 - DNA, 5109 bp, Homo sapiens
cttttggggtctttgctcttttgggtctttgctcttttggggtctttgctcttttggggtctttccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttcgttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcaatgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaaggacatgctgttaaagcttcaaagtgaccagatgaggaaggaataattaattattactcctgatttgtagataactgaggtaagagtgtttcaaatttatgatagtcttttgggtattcagaaacctttccttatactgcactggccaccagagcttaattttcccagcagttacagcaatgggagatagaacagtctcaatcttttgccaaccatcaggttcctagaaaccaggtaggtgtatcccataacaagggaggagcataccacagcccctcatttgattaattcatttgatctatctatgttattaagtacctactaggaataaggcattgtggaaatactatacaaagataaacattgtttagatgcttatctactttccttttcaccagaaaaacagaaaaaaaagaaacattttcttacagagtaaaaatgttctacataatcacatgagtagttcatctcagtgttttttattctttaaagttgaactatcccagtttcattctataccattcattggataaccttgttacaacccagtcatgaaacagagcagtgtgatcagttatctgcatttaacaaatagacaaatcagtttacataaaggttatgtatgtcacccacgatgaaaagaatctgcatttgaatatgcccgtatgaatgtgggttctgtttttgcaacagagattaagtgaccattttttctaattttatggctatatattttcttcataaaaattggtcacatcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctacatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacagctccaagaaggttgtgaagtgagttatgttatgttataaaaatgtgaaagccattaccactatatcctaagttttattttagcaaggtattccctattacatatagtatattgcagaaaatgaataaacattccttgtacttaatttgggaactgctcagcagagaatgcccaaattttatattctgaaagaattaattacacttgctttattttttacattaacagtacttttaaatcacagttctctaatatattctatatttttaaatatgatgaacacaattaaatgttttcatttatatatattgcaacactccctccaaatctttcatactagagagatcagcaatgttgctttcttgccctcgtcctcatttcagcgaaatgtaataattctcccattaaaaaaaatcagatattcaaaatattgatgtaaattgtaaagtttaaattaatcctttcacatattcaaaatattgatctaaattgtaaagtttaatccttttacattctagaatgtactaatatattaaaaccatacagtgtgaataccatttatttatgtccaaacatggccacttttccccactaagtttaatttaggtcacctagtgaagtcttttttaactcataagataggggagggactctcccttaaatgtgcagtgtaacaaaacaaaaattcttttcagaactttcagcagtcagtggtcatgagatgttactaaggttaattaaaccatattagccagttacataatttctaaaatgatagattacaaaacctattcccttcattaaacagacatgacaacccaattctctggttcttgaaactggattttcactcacagatgttttatctactaactttataatgtgatactttgagatcaggctggtggctggcccacactgtcggtagtgtagtctctagaacagtaataaaaggttattacaagaaagctgatacttaaattcatatgtaagaccaggagaatgaatgttgcttctacctcgttagctattaaatcagtgttagagaaaaagtgagatacaaggtttagcatttttaaataatgaggagaaacagactatagatctcagagaaaagcaacaaaattattctcacaattcaaaatatatgctccaaggaaaagttaaagtgatgattatgcctgaaagataagcaattaaaagctccttaggaatgcatctattaactaaaaagggtgcatctcaccaatgtgcctgtttttagaaatatgtataag

SEQ ID NO: 347214 - DNA, 1740 bp, Homo sapiens
tgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatattgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacaatttgccactgtagaagagccaaggaagagaaacttcagcaggcgatagcaatgcacagccaatttcatgctccactataggtaaattgtatttcaagtttgagtctcaaggtgattgcatcagtgttctttaaatagacatgttgttaacggtgcctgttcatcagccttaagcataattctgtcattatagttactgtgctatgtaacatagaatgctttgtattatataataagcataatataaacatataactagtaga

SEQ ID NO: 347215 - DNA, 849 bp, Homo sapiens
cagaaactgactaggagcctgcgtgtgggggcgcggtgggcagtacggaatctgatgcatggtcagtatgctgggcgtctagggaccagtcctgggtgatgacctacctgtttcggagttcctcacacatttacacctacatcgacccggcggcgaacgcgacgtgtactgatacacacaatgaagattggaggagctggacggtcagtaacatggattactaagaaagacacggcagtccaacacgagttggatatcgagatgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagatagtctatttccagtatcccttgctgcccaggcttcgccactgatctttccctttgcccacctgattgccgcgtcagcagaattgttaaaatacaattgtgaagagtaatctccaggtttcacaaagaatggaaaatagaactgttgcaacatcaaaggaaagggaagccagagttttcatcagtgaatgcttctcgtctgagagtcacttatcacgtagtcagtcttcttgagtctctaagatttaccctgttggagcagtctctccccatctcacagcgaccagtgcatgtacatttctcacttctttcatagtcttgtccccacgctcaagaattactttatgttcatcttgattg

SEQ ID NO: 347216 - DNA, 849 bp, Homo sapiens
attcggcacggcggctttttaaatgacccaggcgggggtaatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347217 - DNA, 198 bp, Homo sapiens
tggaaataactgttcttagatttccacagcatagggtgctctatgcacaaaattacagggttaggagcctgtaattttgtgcatagagcaccctatgctgtggaaataactgttcttagatttcattgtaactggactgttcaggttgcccagagggaaagaacattcctaattctaataaaataaacttttattttg

SEQ ID NO: 347218 - DNA, 5266 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347219 - DNA, 5155 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagtcctgtaattttgtgcatagagcaccctatgctgtggaaataactgttcttagatttcattgtaactggactgttcaggttgcccagagggaaagaacattcctaattctaataaaataaacttttattttg

SEQ ID NO: 347220 - DNA, 5188 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatgaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347221 - DNA, 5121 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaagtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347222 - DNA, 4972 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347223 - DNA, 4545 bp, Homo sapiens
cccaattgaagtggctaaggagtattcttgtgataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347224 - DNA, 4286 bp, Homo sapiens
aggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347225 - DNA, 5212 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtgccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347226 - DNA, 4307 bp, Homo sapiens
gagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347227 - DNA, 2925 bp, Homo sapiens
  misc_feature (85)..(85): n is a, c, g, or t
aattacatattctgaaagagcattccgaaagatgggactggttgactcttcacatgatggaggtatagccccccctaaactcagnaaaagatatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347228 - DNA, 2648 bp, Homo sapiens
  misc_feature (13)..(13): n is a, c, g, or t
  misc_feature (23)..(23): n is a, c, g, or t
  misc_feature (27)..(27): n is a, c, g, or t
  misc_feature (41)..(41): n is a, c, g, or t
  misc_feature (43)..(43): n is a, c, g, or t
gtggtgaagtagngagggttggntttngggtgaggaaaggngntgagtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347229 - DNA, 1256 bp, Homo sapiens
cacgtggtaaattgagtacgcatataatatcagactaaattatctgtaattttccacaacccagattgtatgtgttttatgtgtgtttaaataaatatgttagatacacgtgtatacatacacccatatacaacagatccaagactggctgacttcatttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347230 - DNA, 1123 bp, Homo sapiens
atgagagtttagtgtactgatagtcttctggtactgaagtagtaagtgatttgatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347231 - DNA, 1907 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagataccacagcggtctagataatgccaaagggtgctcttgtctacctggacgagatattcccaagatctttgaagatataggggacttgttcagtttggg

SEQ ID NO: 347232 - DNA, 562 bp, Homo sapiens
tgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtaaggaactatattgtcagctttgtacttagaagtaacacagaaagcctat

SEQ ID NO: 347233 - DNA, 558 bp, Homo sapiens
gctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacacctaaagataataggctttttcctaaagtaatgtggcattccagttaaagagccactccaggtacgttttctcagccggcatcaatattggtatatgtta

SEQ ID NO: 347234 - DNA, 526 bp, Homo sapiens
tatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacacctaaagataataggctttttcctaaagtaatgtggcattccagttaaagagccactccaggtac

SEQ ID NO: 347235 - DNA, 403 bp, Homo sapiens
aagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagact

SEQ ID NO: 347236 - DNA, 533 bp, Homo sapiens
tgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctactt

SEQ ID NO: 347237 - DNA, 5288 bp, Homo sapiens
  misc_feature (5026)..(5026): n is a, c, g, or t
  misc_feature (5030)..(5030): n is a, c, g, or t
  misc_feature (5032)..(5032): n is a, c, g, or t
  misc_feature (5041)..(5041): n is a, c, g, or t
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttnggtncnatttttgtnaaaccccgggatagagcctggggcaggactggggcgggtggtgcgcacacagaagggcatatgtaaagggcctaacccgcaattgtggctaaagaccatcgggaaaaagggtcgaaaggaaagaggagcaacgcccgggaagagaaccacccaaaaagacagtgttgcaccacaaaagagaggcggcgcagacatagaggcgcaagaacagaagtatacgacgacacaaagccactcacacagcaca

SEQ ID NO: 347238 - DNA, 5334 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagtgcatattgggtacttccagaagtatgaattcagtgatgcaaaggacaggcgggctgcagcagcaaagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347239 - DNA, 5072 bp, Homo sapiens
agctgggactacaggtgtgtaccactacacctggctaatttttgtatttttattagggacgggttttgccttgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347240 - DNA, 5212 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttatttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttg

SEQ ID NO: 347241 - DNA, 2190 bp, Homo sapiens
acgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccagaatccagcaactatcacaagaatactccttagccacttcaattgggataaagagaagctaatggaaaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcgtatttcactggccttgaatgtggacataagttttgtatgcagtgctggagtgaatatttaactaccaaaataatggaagaaggcatgggtcagactatttcgtgtcctgctcatggttgtgatatcttagtggatgacaacacagttatgcgcctgatcacagattcaaaagttaaattaaagtatcagcatttaataacaaatagctttgtagagtgcaatcgactgttaaagtggtgtcctgccccagattgccaccatgttgttaaagtccaatatcctgatgctaaacctgttcgctgcaaatgtgggcgccaattttgctttaactgtggagaaaattggcatgatcctgttaaatgtaagtggttaaagaaatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaac

SEQ ID NO: 347242 - DNA, 412 bp, Homo sapiens
ctctgagcaagagctaaggtagaatgggctgaataggaaaaaacaaagctagtcctgggaatgggcaacttgccatctcaccattcccaaacccctaaccctccacggcccagccaccaggagccagcagccgcgagtcagtgtggaaatggctctctgcagagggaaccagaggctgcagacagcaaaggcgagaggatgctggccttggagagggccgttccccaactgcctccagcccagagcagggtggggaaagccccgagagtctctgggcagaagctggagtgggtggagaggggaagctccggcccctgtgtccaggtagcaaagccctgtcctcacatttcttacttgcaaccaggacctacatgtgaaatgatcacttctcattaaaaaccaccttcattgc

SEQ ID NO: 347243 - DNA, 289 bp, Homo sapiens
gggggcctttggtctcctaccgctcgggagtgcccctctcccccagcgcctctgaataagccccgggtgcttgcaggctcctgcacttctgcagtgcgggcggcaggaagcagcgcgtcccgggccctctcccgttctcacggggccttgaacctgtgtgagaggctcaccttctcaaaaacggctggctgcccagaggggatctctgtggggaactgtcgatgggcagaagcgccagctcctacttgatttctgcttcccccattcccctttctcctggtggccctgc

SEQ ID NO: 347244 - DNA, 453 bp, Homo sapiens
gggtcagcaaactctggcccatgggccaaatctagtctgttgccttttttgtacaacctgcaggttaagcatggtttttacattttcaaatagttgtgtaaaaatatcaaaagaatattttgtgacaagtagaaattttatgacattcagatttcattgtcataatgttttattggaacacagccatacctgtttgtttaggtataatctgtagttgttgtgttttaggcagaattgaatagttgctgtagagaccatatggccaacaaagcttaaaatgtgtactgtctggtcctttgcataaaaaggttgccagcccctattctagaattattgaaatcacatccctaccactccatggccagtaaattgaaagatgcaaggaaagacaaattaaattgatttaattgggtgtgaggtgggataggatcaaatgagagataaaatgtttat

SEQ ID NO: 347245 - DNA, 1700 bp, Homo sapiens
gtctgtaggaattgaaccttccgtgccgttttcaaatgctgtctgtgctcggaaaatacataatatcaagtcccttactgaaccccctacagattgtgttcataaggtgcttcactgctgttggtctacctggcctactgtttgtactcctgcctcatttactgtggccttcattcaagtagtaatgattatttacctattaagagtatagggtgggcgtggtggctcatgtaatcccagcactttgggaagccaagatgggtggatcacttgaagtcaggagtttgagaccagcctgggcaacatgatgaaaccccatctctactaaaaatacaaaagttagctggatgtggtggcagcctcctgtaatcccaactactcggcaggctgaggcaggagaatcgcttgaacccaggaggtggaggttacagtgagctgagatcatgctacagcaccccagcctgggcgacagaagagagacactgtctcaaaaaaaaaaaaaaaaaggtgtaagggagggcagaaattcttattcttttaaacccattgaaactttaaacagcctttcaggagcagaccctcctacggatttgctgaatccaaggcgaggaaggctatatccaggttacagtgaagtttgccccagacagtatgaagatgggggttctagatctggatactccaggcagtttttactatgtgaccctgtgcctgtcacagtatttcagcctgtaaaatatggacaatgtttgcctttttggcttccagttagctttgtgaggattaattgagatgagtgcaaagctcatttgtaatgtgtggcaggtggttttattactattttgagcagtagtggaaaagcccatttgaactggtaggatgagataagatcatggtggccttgacaactacatggaggagccagttgggtatgggaaagtttgagcagggaaagaaagaatgtagtgaaagcagtgtcaggtcaaagaaaggtttgcctaggagtgatgtaaagaatgggatggaggagtgggcagggaaggaggaaagaggagacatgtcagagggaccaaaaaggaggcagcaagtccaaggtcacaaacctgagtgactagaaaacttagcagcatcactaacacccagttggtgacgtggaactggtgctctcctgggagagagcttcaattctcaacctactaagttgaaggtgatggtgctatatctaagtggcagacagagataagggataggtgtctacaggggcaagatttggagccaggagaagaaatgagctctccaagggtagtggagagagatctgggatgttgggggctggcaggtaaatgctttaagtgatagaataggaggaatgagaaagccagcaaaagaaattcacgtcccatgtcttccatcatctatatgtctgacttgtttaagtggtcctggattcaccaaattttatagagctctgcctctgcctttattgggtaggcctgatttttgatgatgtccttaaaaggctagcctgattcttcttgtagttttgtagaacactttgtatcgagagttctctgataatgaaagtggtattacagaataatctgcccccgaaggactcctgattttgttaaagtgatacctttctctgtaaataaatgatggcgtgccacttaaaaaaccttcagcagatttcttttttt

SEQ ID NO: 347246 - DNA, 327 bp, Homo sapiens
gacagtgaaaactaaagaagggacaggagagaggaggccaagagccatgggctcctttagagggtcgtccttgctggttgcctatcccagggaatgcttactggactctgctgaaggtgccacttccctcagactatggtgggagcgggtatgaggatgagggtggcatgcacagagttgagttaacaggtgtgggaatcccttcggtttctcttggtgggtgggcccattcctagggggatctaggcagaggtttgggaggtagtgccacccactccccatcttcactgcctaaaccagagctacatggtgatttctttctttggg

SEQ ID NO: 347247 - DNA, 236 bp, Homo sapiens
caagatcatgcccctgcactctggcctgggtgagagagcgagatgctgtctcatacaaaatgaaacaaaaaacccccaaaatttagtatattcaaatagtggaatattatttagccacaaaaagaaatgaagtactgttctgtgctacaacatgaatgaacctagaaaacatgctaagcaaaagaagtcagacatcaaaggccatgtggtgtatgattccattcaaatgaaacatc

SEQ ID NO: 347248 - DNA, 1696 bp, Homo sapiens
  misc_feature (1204)..(1204): n is a, c, g, or t
agagaagcgaggtttccattctgagggacggcgtagagttcggccgaaggaacctgacccaggctctgtgaggaggcaaggggacaggccaacccagaggacaggattccctggaggccacagaggagcaccaaggagaagatctgcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcgacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtncagcagcttcccctgcctcgtgtgacatgaggcccattcttcactctgaagagagcggtcagtgttctcagtagtaggtttctgttctattgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcct

SEQ ID NO: 347249 - DNA, 559 bp, Homo sapiens
ttttcagtagagacagggtttcaccatgttggccaggctggtgtcaaactcctgacctcaggtgttccacctgcctcggcctcccaaagtgcagggattacaggcgtgaaccacagtgcctggcccagagtaaacttttaaaaacacagctctgaggaatatcaggcacagagtccggcacatagtaggcactcaatacatcacaaaaggcctgcttcaataattatgtttcagccactctctggaatatcatgaagctgtttttaaaagggaggaagggggctttcaggcatccatcacagtcacacaggcaaaattatggaatgattaacgtagcagtatatgtcaattacacaactattcataatagcaaaagactagaagcaactcaagtgttctcaaatagggagactggctgaaaaaaagttcatacataatcaaaggccatggggcttcaacacctgtgaaagtaagtgaaaaacatataaatataaataaaggaaaaagactatggaactgtaacaagaaaggaagaaaaaaacaaaaaaatgagaacaat

SEQ ID NO: 347250 - DNA, 260 bp, Homo sapiens
attcatgaacccccacccaagtctattaaccccagggcttttgacactagcagagggaaaggcttctacccagattaatgacaggggctattcaaagattcttgaccagtgtccaaaagaaaaaaatatttaaattagcatccactatgggctggattctatgctgagcactagagtcacaggtggtgcacccactgtgagacacaaatacacaaacagacaaacacaatacagtgttaaaggagctgtaatagccaaaa

SEQ ID NO: 347251 - DNA, 686 bp, Homo sapiens
  misc_feature (9)..(9): n is a, c, g, or t
  misc_feature (38)..(38): n is a, c, g, or t
  misc_feature (41)..(41): n is a, c, g, or t
aatcgcaancggcacactggtctggaaccccggatatnagncttcgaccctgaaatccttggggtgcctcgaggacgactggccgaaaagccgcattccctgcctcacaggccggaagtcccagcccagtccccgcgcgcgtccctcttcctcctcatactccccctctgtgccctcaggtgtggcggtcagatgtccagtttgcctggaagcacctcttgtgtccagatggtgagttcttggggagggggaggtaagagggaggctgggcactgaggaactgggcttggcctcatcctgcttgactcagtctcttacagacacctggggctcttgatcctggcactgctggccctcctcaccctactgggtgttgttctggccctcacctgccggcgcccacagtcaggtaagctcacctggggtaacctgggaagtcagacctgcccagctcggagactagctgccccctcaccctcccctgttgagagaaaacctccttgagggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaacta

SEQ ID NO: 347252 - DNA, 2009 bp, Homo sapiens
ctggaagtcagtgcacttcactgactacagccagcacactcagatggtcatggccctgacactccgctgcccactgaagctggaagctgccctctgccagaggcacgactggcataccctttgcaaagacctcccgaatgccacggctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggctagcagctggagcagacacaaacccacctgggaagaattccctagccagtggggactcccctctcccccagctccatgcttcactcagctccccgggaggagaagatgcctggctcataggggtggggggctctgtgtctgtgccctcaggtgtggcggtcagatgtccagtttgcctggaagcacctcttgtgtccagatggtgagttcttggggagggggaggtaagagggaggctgggcactgaggaactgggcttggcctcatcctgcttgactcagtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgagggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaacta

SEQ ID NO: 347253 - DNA, 1555 bp, Homo sapiens
  misc_feature (9)..(9): n is a, c, g, or t
  misc_feature (38)..(38): n is a, c, g, or t
  misc_feature (41)..(41): n is a, c, g, or t
aatcgcaancggcacactggtctggaaccccggatatnagncttcgaccctgaaatccttggggtgcctcgaggacgactggccgaaaagccgcattccctgcctcacaggccggaagtcccagcccagtccccgcgcgcgtccctcttcctcctcatactccccctctgtgccctcaggtgtggcggtcagatgtccagtttgcctggaagcacctcttgtgtccagatggtgagttcttggggagggggaggtaagagggaggctgggcactgaggaactgggcttggcctcatcctgcttgactcagtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgagggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaacta

SEQ ID NO: 347254 - DNA, 922 bp, Homo sapiens
ctggaagtcagtgcacttcactgactacagccagcacactcagatggtcatggccctgacactccgctgcccactgaagctggaagctgccctctgccagaggcacgactggcataccctttgcaaagacctcccgaatgccacggctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctgtctgtgccctcaggtgtggcggtcagatgtccagtttgcctggaagcacctcttgtgtccagatgtctcttacagacacctggggctcttgatcctggcactgctggccctcctcaccctactgggtgttgttctggccctcacctgccggcgcccacagtcaggtaagctcacctggggtaacctgggaagtcagacctgcccagctcggagactagctgccccctcaccctcccctgttgagagaaaacctccttgagggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaacta

SEQ ID NO: 347255 - DNA, 1732 bp, Homo sapiens
cgctggtacggccggaagtatgggataacagcagccatgttgaatcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggctagcagctggagcagacacaaacccacctgggaagaattccctagccagtggggactcccctctcccccagctccatgcttcactcagctccccgggaggagaagatgcctggctcataggggtggggggctctgtgtctgtgccctcaggtgtggcggtcagatgtccagtttgcctggaagcacctcttgtgtccagatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgagggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaacta

SEQ ID NO: 347256 - DNA, 629 bp, Homo sapiens
ctggaagtcagtgcacttcactgactacagccagcacactcagatggtcatggccctgacactccgctgcccactgaagctggaagctgccctctgccagaggcacgactggcataccctttgcaaagacctcccgaatgccacggctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggtatggcctcgcccccactaggtcctattgctcagagcacagccctcaatttccttgtgacctcattgagatagaccctgggaaggcagaaacaaacaaatccctgacttttaccatctggtttactttatttacgtgatcagcctctgttcagctaacttgctgacagtaggttcctcaagggagcactttcttttttttctttttttcttttttt

SEQ ID NO: 347257 - DNA, 849 bp, Homo sapiens
ccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtttggcttgaagcatttgctgttatgctgtgtggagggaaggggaacctgctagttaggaacatgtggcatgcatgtactagaagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatga

SEQ ID NO: 347258 - DNA, 575 bp, Homo sapiens
ccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgaacaggggaaagaaactcagttgtctaacaagatatttttaaaatatttatttctccaagagggttaaacctcattcacaccttggagtaaattacttta

SEQ ID NO: 347259 - DNA, 428 bp, Homo sapiens
agttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgtgcagtggctcatgcctttaatctcagcactttgggaggccaaggcgggcacatc

SEQ ID NO: 347260 - DNA, 127 bp, Homo sapiens
ttgatggacttttgttctttcttccacaagattttggcgacccagaaagggtaaagacatgataagagaagatgcatcctgaacaacttttattgtgagtagaaaaaaaatagcataaagtgagcat

SEQ ID NO: 347261 - DNA, 604 bp, Homo sapiens
attttgggctttgttgttgccattttttttttcaatttcgataaggctacatttgacgccgtatcatgatgattacaatactggctctgataatacctggtgattttaaaggatttttttaagcccattttgagccttcctgtttattgtttcttcttcattggaggaagatattaaatatgtgaaacacatctgcaaatggtacttgaaaaatgaaatgaaatgcctttgtgcttcttgcagcccattctacaatttattttaacttcacagttaaaaagtgtatattttttattttctacctatctagttatagcctaattgatttctttggacagagaaacacattcagtagacaaactttaggtgaatggaaattagtcctgatctattttgacatagctctttatttttcatgtgtaacgcagcttgccttcatgggcaggaaggtggatggggaagccgcacgtgcctggcgtagtgtagatctaatagcggtcgtgttacgaagattaaatgagttaatgtttggaaacctgttgggacagagctggcaaacggtgaatgtgttgcatgcatcaactgtgatgatgcattccagtgt

SEQ ID NO: 347262 - DNA, 779 bp, Homo sapiens
taacttgccagcacccaccacatgagcaatttattaaattaaacagatcaggccccatgtgcatgtgtgtgtgtgcgtgtgtgtgtatgcgtgcgcgtgtgtccttttggtttggtttctccagaaaacgctgactaatactgtatggtttgggaaacatttcaggaaaactttggcagggagaggggcacaaaggataattaccaactaaatatccaactctctcactttgcaagtttctaatttgtggcttcctcagtctcagttccacattatattaaaacaggccttcctgagagtccacaatttcaaacaaacctctcaaggaattcgattcactgacccagaggaggcaaagcgaattatttactatttggcttgtagcagaagctacctgacatttttatgcatgctttacgccctctatccaactagactataccttcactagggactcttagcacctagcctgacattctaaacgtaatgctcaataaatggtcaaattgaattgagtcaaacatgtcgttctcagattgctccattacagtatgtcaacctccacaaatgggagcattctaggcagacccaaggggatgggagagcatttagagatagctcttatctcttacttctcttctccctcccctccacacacatttctaaatctcatttctgctccctgttcttctctctgtgcctggcctcatgcccaaaatttagtcagcaattctcaagaaccaattggaggtagagccctgcgcttgatacctggtggg

SEQ ID NO: 347263 - DNA, 576 bp, Homo sapiens
agtccctcctgccgcgagccacccagggcggcggcctgcagctgcaccagtcgcgggacagatcttgacccatcttatcaccgtcttctctggcactcagtatttggagtaatcagttgttaccagttgcggaggcagcgcatagcacaacgtagtacctggaacctgacggcacctagcatgtttcaacagttagcgcccgcatcaccccaagggattaaatttggcattctttctcttgagactcaagtcctggcagagctgttgatcctctcacaagattctgtcatagaagacaccaggcctgaagagcgtgatgtagctggagctagctacacctcttgatagctaagactccaaggctccagacaccttggtgattgcactctccaccatgccaggaccgcagtgccagtttaccccactcacctgtagagaatgtatccggcggagatggagtttcactcttgttgcccagactggagtgcaatgacacaatctcagctcaccacaacctctgcctcctgggttcaagcgattctcccgcctcagcctcccgagtagccgggattatag

SEQ ID NO: 347264 - DNA, 379 bp, Homo sapiens
catagcggctgcactattttccattccctctagcagtgtgcgagggctctgattctccacatcgttcccagcacttgttactgttgttgtctacttagcagccactctagtgggcgtggagcgacctcactgtggtttggtttgcgttttcctggcagctgatgctgttgagcatctttgcatgtgctcattggctgtttgggtatctttttttttgtttttgttttgttttgtttttgagacatattctcactctgtcacccaggctggagtataatggcgtgatcttggctcactgcaatctccacctcctgggtttaagtgattcctttgccttggcctccaagtagcttggactacaggcgcccaccatcacacc

SEQ ID NO: 347265 - DNA, 760 bp, Homo sapiens
  misc_feature (15)..(17): n is a, c, g, or t
cgtacttagaggatnnngagtgggtagtgtcctccctcccctcccgctctccttactcagtgaccccagcaaggtccctgatggatgtttcaatggcccagtgagtagggagcccagagcttcactgtgccaagagaccctccccaaagcagccaagcaccttctcacagggcaaggccttggagcaggttcccaaggagcccctcctcatcctggaagaagcagtccctaaacagagctcaacaacactccctggctgtgcagcattggataactcacttcacctttctgagccttccagatttcccatctgttatatgggcattaataatatcccctacttccacagagttgtcatgagggttaaaggagctaatacaagcaatgtgttcgtagtggtcctggcacattgcactcaataaagaccagtctctgtgaaacatcgttgtacactaagtgttagctccatccccactcttctccaagcttcagtttcctcctctgtaaaaaataatgcctgccctgctcaagggctattataaggttcagaggagattatgggtgtaaacactataaagtcctataaaaattgaagttgtgctttccagccttccagaagaatccaacccattccaagatctcttttcttccagagcccacaatgcagtgccccaaacactctcttcttgcagtcatctttctaagcagagagatccccaccttagccagaaaagggctccatttggccaatactgtcccc

SEQ ID NO: 347266 - DNA, 778 bp, Homo sapiens
  misc_feature (4)..(4): n is a, c, g, or t
  misc_feature (9)..(9): n is a, c, g, or t
caanccccnaccccccagccacacccaccttgaggtgagcacggggctcctccctcccctcccgctctccttactcagtgaccccagcaaggtccctgatggatgtttcaatggcccagtgagtagggagcccagagcttcactgtgccaagagaccctccccaaagcagccaagcaccttctcacagggcaaggccttggagcaggttcccaaggagcccctcctcatcctggaagaagcagtccctaaacagagctcaacaacactccctggctgtgcagcattggataactcacttcacctttctgagccttccagatttcccatctgttatatgggcattaataatatcccctacttccacagagttgtcatgagggttaaaggagctaatacaagcaatgtgttcgtagtggtcctggcacattgcactcaataaagaccagtctctgtgaaacatcgttgtacactaagtgttagctccatccccactcttctccaagcttcagtttcctcctctgtaaaaaataatgcctgccctgctcaagggctattataaggttcagaggagattatgggtgtaaacactataaagtcctataaaaattgaagttgtgctttccagccttccagaagaatccaacccattccaagatctcttttcttccagagcccacaatgcagtgccccaaacactctcttcttgcagtcatctttctaagcagagagatccccaccttagccagaaaagggctccatttggccaatactgtcccc

SEQ ID NO: 347267 - DNA, 1119 bp, Homo sapiens
tttactttaaaaaagaatttatttgttacagccctgggggctgagaagtccaaggttgaggggctgcacctggtgagggccttcttgctgctggggactctgcagagtcctgagggtggcgcaggtgtcacatggccagggggcggagcatattcacaggccagctcaggtcttccttcctcttctaatgaagtcaccagtcccactccggtgataaccctttaatccatgaatccatcgacaggttaatcccaaccacgcttagaggccccacctctcagtactgccacattggagattaagtttgaacatgagtttcattgaggataaacatccaaaacagctcatcccaaatctaaatgtttcttaaatcaactaatcaattaaaaaaagaaaacctctctgggctgaacaaggcgtatcagtgagctaaagccagcctacatgcctggcagtgccaatctacctcaaggtcctcagaactctccagtcccctcacctttccctaagaccaggtgacttgtggctccctgaacacagcaagcaggtcctcacatctgagcatgtgggcctgagcgccctttctgcctaagtcacaggcccaacacatcctgctcggcagcctcagcaacaacttcctcctgcccagaaggccttcctcaattgcttctccccaccataggccggatcaggtgagacgtgctcacgtgtcacacctggttcacgtatgtcgtggcaggatcttttcacttggagggttcaaccaggattcttggtgctgttccaaggcccccctccccaccctgtcacctcagctttgtgtccataaatgttcactgtatttcataaaccagaaaaaaagcagtgtctctgcaataaaaagaactcttacagaaaacttagtgtgagatatgtatagctgtgtacatatgtacactgatttttggttactcacttgacatgatgtgagtgctatgaagttaggcctggagtgctgggaactggtgtcccctctgtttttttgtttttatttttttgagatgcagtttttgctctgttgcccaggctggagtgcagtggagcaatctcggctcactgcaacctctgcctcgtggattc

SEQ ID NO: 347268 - DNA, 2538 bp, Homo sapiens
atcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctctttgtgatcttcctgattccacctacaagttcattagttctaaataaaagcctgttggcaagtgttgg

SEQ ID NO: 347269 - DNA, 2484 bp, Homo sapiens
atcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctctttgtgatcttcctgattccacctacaagttcattagttctaaataaaagcctgttggcaagtgttgg

SEQ ID NO: 347270 - DNA, 1806 bp, Homo sapiens
atcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacgggacactaaattttgattcaaatgaaccccatcttatgaaattgaggtatggttggagaaaaaaaatcaaattccaatgtggattatttataaataaagatcgatccgccg

SEQ ID NO: 347271 - DNA, 1624 bp, Homo sapiens
atcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcaggtatgttgctatgggaacctcgtgggatcttaataattaatgttttgacttccagagaaaaaccttgacatttattatagccttagtaataaatcatattgttgacatgtgccctgcttcatattctctaagtgccccctagttaaaattcaagtagaaacttttttcacacctgttt

SEQ ID NO: 347272 - DNA, 3546 bp, Homo sapiens
atcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcccaggccacacaaatgatgtgatggttaacatgatagcgctcactgcactccatactgaggaggaaaattataatgtggttgcaccaggctgtctttcacaatccagtgacaccacagccaaagccctatgggaagctttactgaacactaagcacaaagaggcagtgatggaagttcggagacatctagtggaagcggcaagcagagaaaacctgccaatcaagatgagtatggggagagtcacaccgggacagctcatgtcctatattcagctcttcaagaacaacctcaaagctctaatgaatcattgtggcctcctccagcttggactggccacagctcaaacgttgaaacacccacagactgccaagtgggacaactttctggcttttgaaaggctccttcttcagagcattggggagtcagcaatgtccgttgtgttaaatcagctgctgcccatgattaagcctgtaacccagagaaccaacgaggactacagccctgaggaactgctgatccttctcatatatatttattctgtcactggagagctcacggtagacaaagacctgtgtgaagcagaagaaaaagtcaagaaagcattggctcaggtcttctgtgaggaatctggattgtcacctttgctgcaaaaaattacggactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggcatcttataagccattgttgaagcaagttgtggaggaaatatttcatcccgagaggccagattccgttgatattgaacacatgtcttcaggcctcactgatctccttaaaactggatttagcatgttcatgaaggtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctctttgtgatcttcctgattccacctacaagttcattagttctaaataaaagcctgttggcaagtgttggtagattacaactctttttatttgaagttgctcgagaagttagacatgctttagaattatgagtgtggggaaaatttgatgttccttaggattatataactgaggagggaacattgcaaatagggtctgaggctttgtttctctcttgctctgaaacatttctgaaaaggcaaggaagggaggggtagtgtctggggcagtgctggtagcctgcatgtgttgtaaatcatcctgccataacaaaggactgcattgttctagctggcccactgggcaggtctgccaggctacttggaactgtagtgggaaggtggttgattggagggttatctgtatataaaaggttttctcccctccaaagaaagactccagtacaagatacctggtcccagggagtctaaattgtaacagcaacccctgtggactttgtgggtatgagttttgattgaaatataaagctttcttttctgtaagtttaagttttccatctgaccatagcagaaaaacctagacccacctagtgaaactttgtaagaactccagggcaaaaacgaaccacttgcaacccacatgtttgtaggtgtatggtcgatggaagtttctggcatccatgttggtaataaagagataaaactgaaaaggtttttattgtggattacacaggtggaggaaataacatgtaaaccaaaacactcacatgtctctgattttagttctctataaaacactgtcatttttgaaagaaccatgaagttggagattattttaagatgtaatcaaagcaggatttttgtggacacagacactcttttcttgcccaggtatgttttccacataatatcagttctttcatgaaatagaggagaccgcaggtgcctttttcattctactaatcttaaagtgttgaatttgaataaggaagttaatggtagccatccgtaagaaatgttaaagaggagacgacttttctaaaataaaaaattggaaagtaacctgtacgtgactcaaa

SEQ ID NO: 347273 - DNA, 1596 bp, Homo sapiens
atcagggagcgtgtcagaggccgaccacgtgtactgtggagactgtcaaagtctcccggagcccaatttccggaagcggtgagttctgaaagaagttcctgcaccgtagtttcccaagtctgcgaatccccaaccatgagcgcctcgggcgtactgtcctttacccagcaaggatgggagcaggtgctggccaaagtgaaacgggctgtggtttacctggacgccgcctgcgccgagagcctgcactggggctgcggatccacccgtctcctggaggcggtggggggtcctgactgtcacctgcgagagttcgagcccgacgcaattggtggtggagccaagcagcccaaggcagtgtttgtgctgagctgcctgctgaaaggccggaccgtggagatcctacgggacatcatctgccgcagtcacttccagtattgtgtggtggtcacaaccgtgagccacgctgtccacctcacagctaatcatgtcccagcggcggcagcggccgagatggaggggcagcagccggtgttcgagcagctggaggagaagctgtgtgaatggatgggcaacatgaactacacggccgaggtgttccatgtcccgttattgcttgcccctgttgctccccactttgccttgactccagcttttgcatcccttttcccactgctaccccaggatgtgcacctccttaatagcgcccgaccggacaagaggaagctgggaagcctgggtgatgtggactccactacgctaaccccagagctgctgctgcagatcagatgcctagtgtcaggcctcagttctctgtgtgaacatttaggagtacgggaggagtgttttgctgtaggttccttaagtcaggtcatcgctgcggatctggccaattatgcccctgcaaagaacaggaagaagactgctgcaggcagggcatcagtggtttttgtggacagaaccctggatctcacaggagcagttggacatcatggagacaacttagtagagaagatcatttcagcacttccccagctcgtgagccggcctcatcctagtgactaccccctcctgatcctctttgtggtaggtggggtcacagtctctgaagtgaaaatggtcaaagatcttgtggcatcgttgaagccaggaacccaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctctttgtgatcttcctgattccacctacaagttcattagttctaaataaaagcctgttggcaagtgttgg

SEQ ID NO: 347274 - DNA, 1770 bp, Homo sapiens
cagcaaggtagtggctgggctctgcctgtcaaatgtacctagtgccagtctcagccatcctgagtgccccattggctaaaggttcagtagacacagcccggctgtcccacaggccatctgtcccagactgtgcccccctccttccaggcagggcactagcgccaggtgccattcagctggctgccttctacttttccttcctagaacttcacttcatgccctcccccaaagacatttgttgcattctatttctcatcatccaataccctgagattggcccccctaattccctgcggtgtgtttgccctctcctgttgttaggtaatcgtgctgtccacacgactcctgaagccacttaacattcctgagctgttatttgcaactgaccgactgcatccagaccttggcttctgagcatccgctaagaagataagacctactcaagctggaaatgccgatgcaattttctgccaccactccaaatactcctccacaaccagcgtccctgtcactaattgcgagaatgatggaattctgcctgaagggtcttgatacctactcagtgaggtactttgcttggattgctgtgattcttaaaaaaaaaaaaaaaaagtttttttattttcctgaaggcgacagtctgtcttttggcgagtccaattagtgatcgtttccatttatccttaaccctctctttgtgatcttcctgattccacctacaagttcattagttctaaataaaagcctgttggcaagtgttggtagattacaactctttttatttgaagttgctcgagaagttagacatgctttagaattatgagtgtggggaaaatttgatgttccttaggattatataactgaggagggaacattgcaaatagggtctgaggctttgtttctctcttgctctgaaacatttctgaaaaggcaaggaagggaggggtagtgtctggggcagtgctggtagcctgcatgtgttgtaaatcatcctgccataacaaaggactgcattgttctagctggcccactgggcaggtctgccaggctacttggaactgtagtgggaaggtggttgattggagggttatctgtatataaaaggttttctcccctccaaagaaagactccagtacaagatacctggtcccagggagtctaaattgtaacagcaacccctgtggactttgtgggtatgagttttgattgaaatataaagctttcttttctgtaagtttaagttttccatctgaccatagcagaaaaacctagacccacctagtgaaactttgtaagaactccagggcaaaaacgaaccacttgcaacccacatgtttgtaggtgtatggtcgatggaagtttctggcatccatgttggtaataaagagataaaactgaaaaggtttttattgtggattacacaggtggaggaaataacatgtaaaccaaaacactcacatgtctctgattttagttctctataaaacactgtcatttttgaaagaaccatgaagttggagattattttaagatgtaatcaaagcaggatttttgtggacacagacactcttttcttgcccaggtatgttttccacataatatcagttctttcatgaaatagaggagaccgcaggtgcctttttcattctactaatcttaaagtgttgaatttgaataaggaagttaatggtagccatccgtaagaaatgttaaagaggagacgacttttctaaaataaaaaattggaaagtaacctgtacgtgactcaaa

SEQ ID NO: 347275 - DNA, 553 bp, Homo sapiens
atggtagtgtgattgatgagctacagtctagcaatatagcagtgcaggtagagactagaaacttgggagctggacacggaggctcacacctgtaaaccaaggttttgtaaactttttttctacagatgaggtgttgcttatgttgcccaggctgctctcaaacccctggcaccaagtgatcctcccacctcagactctcaagtctctgtgtagccttagccaccacacttggcttcaattcttataagaagcaaaagtaggcctggcaaggtgactcatgcctgtaatcccagcactttgggaggccaatgcaggtggatcactgaaagtcaggagttcgagactagccgggccaacatggtgaaaccccgtctctactaaaaacacaaaaagtagccaggcatagtggtacatgtctgtaatcccagctactcaggaggctgaggcaggagaactgcatgaacctgtgaggcagaggttgcagtcagccaagattataccactgcactccagcctgggcaacagaatgacaccttgtctcaaaaaaaaaaaa

SEQ ID NO: 347276 - DNA, 959 bp, Homo sapiens
  misc_feature (787)..(788): n is a, c, g, or t
cttgctcacttgcagaagttggcaagtgacgagtggccagggaccgtgcgtcagggcgtccctctgccctcagcctgctgtgtttcacccggtctctggtgagcacatctctggctgctttgcgtgaatgagccaagggagggatagatctagcttactgcctccccctcccttaagccaagcagaatggggtgtgtgtgcacacctgtggtgaacgaatctgtccgttcaccctgtgccagggccgtccttacagcaaggaccccggggatgtgtccgtccccatcagtgtcatgttagcaagcagtgacaacatccctttgcaggaggcatcctgaaccactctgtcctcagacagtggcagagcccaagagaacaatgtgccccacccctccaccagcctcaggaatcattgtcttgtccccatcacagcagccctaagactcagggcacatgcgccaagcctggggggctagtttctgtgtgggaagcgatggggaagcggtgaggagctcctggagaaggtggcagctttcataccgggtgatgttctgactctggtgttctctcccatctcagcacccattctgctccccagtcaggttggttctttgtggctcagatctgtcaccccttaatgaagtggctttctggctgccaaggattgagagctgctactgaggagtataagtcactaatagcattggaaaacactgtgaaatactccaaggtgccaagctgggcccagcccagtgtggttctaaaaggctaataaaaatccaccatnnaaaaaaaaaaaaaaaaaaacccgggcttcttcgggtgcgggaaaaggttgatggctggcttttttccgccctttttgaagggaatcggccctaggggcttatcgactgtctttctaaatcataacagaaacaacaagacacaaacaacaacaacaaaaaaaaagaacaaag

SEQ ID NO: 347277 - DNA, 650 bp, Homo sapiens
aagccacatttgaaaaacttgggagagaggaggagaaaaaggaagccacacagaattttggtgccacgaggaggaggacatctgtatcttgtatttgcatggtgttttacagtttagaaaacacagacaccatcataggtcactgtgaggtgggcacatttattactattttccagttgcagaaatcatcacccagaaataagggaaaaacctgattgcaagtcttcttatatgggtctgttctttctactacatctaagacatttctctgtggcatgcctgcactttgcagtgttatcttccaaacaccatctactttcagaaccctacacttcggagaaactgtacttgtaccattcttcaaacacgctacaagttttcctgcctctatgtatttgttcatactatttcttccccttaaacttctttacccaacttggactgttagaatgttgcccaaacctttcaaggtctaaatctccatgttacctgtttttcttctatgctattttttttaacatgattctttgtattacagatatttacaaacatttcttctcccatactaaatttaactttgtattcattttactgcctagtaaagctccttgcatagtaaggaaactagttttgaattaataggccagtca

SEQ ID NO: 347278 - DNA, 1297 bp, Homo sapiens
ccacacctggcctgcactcattttaaagttggaaaaacagaggccccagtgattagctttaggacggaaaccagtaaatagaaataaaaacacacaaaaatatatacatatatatacctacacacatctatacctacaaatgtttatatatgtatatacacacatatacacacacctgtataatatacacatattatatatattatttatttatttaagtttttattctttgtttttttgagacagagtctcactttgttgcccaggctggagtgccatggcgtgaccatagctcaatgcagcctcgacctcccaaacacaagcaaacctgcctcagcctctcaagtagttgcgactacaggcatgcaccaccacacctggctaatttttgttttattctttgtacacatggggatcttgatatgttacctaggttggtcttgaactcctggcctcaagtgactttcccacctcagtatcccaaagtgctgagattacaggtgtgagccactgtgcccagccaaaaccaaacatttttgagttaaaagcccctaataaggatggcagaattagataaacaaataggttcaataaagaagatcttgacaaagttttaatctactaatttaacgataatggaaattagtggaattcgagagtgaagaaatttctgcatttataaaagaatgaatagaattttggcagagaagccactttgtttttgaaacgagttaagaatcaaagaataaattaggatgatggcattacctggttaatgatatccaatatatgtaaattatctttgctgtgggtaggaaatttgtttattttccatgagcacttcaagaaccccattaacaaattgagttacatcttttgactcaactttcattatctgaatagtcctgctgggacaggtaatattctccatttggggctacaaatgtttgcattagaaatcaatctatttgtaaatgttgtattcaattttacatgatcttgatcttattttgtttaaatttgttgtttttttcaatgacaagttgatgcttccataatacatttaaaaacataacatacaatcctgtagttctgactgaactttcgtcaggtttcagcactgtaaaccaagaaacatcaacagatgaaaagttctcctcccaaaagggttaaaagtctccggggtttctaactagattgacttcagtatattctagacattcttttgctgttgcttggctcatttccttcttgataagattctattttccttcctcttcctcttctctctgttact

SEQ ID NO: 347279 - DNA, 1769 bp, Homo sapiens
ttgtttcatgtttctatattttgtctcccagttagattgaaacccgttgaaggtacagtatgtgtgtgactccttccatctctaccccaccactgatccattttaagcatttaataaaggcaaggaaggccttcacctttattaacttttttgaaaaatcagaattttcagcccacaattcactttcaaaaatacacattaagtgcctactctgtgccaggccctgttttaaggcacaagtcctggccttcatgaaacttacattccagtcagggagacataataagcacataaattatcaataaatactatgaagaaaaataaagcaagataatacagtggcgactggcggggtgacagattttaaacagcctggtcacagcaaggccaagaagagagcactgcatttttaggacctaaaagagaatatgcaggccttttatgttctcctcttcacagatcaagcctaacagtactcgtttcagtattaggcaggttagaatgccctgtgctgcaggaacaacaacaaaagctcagtggctttgcacgtaaacgttcacttctctctcacacaagtcgaatgcaggctagtgagggcttccctccacgtgttggctcagttgtctgggttctgctgccatcccaacactaggtcgcctgtgcacagagaaatgccaggggatgacagctcccccttttagtgattcactttttcatttacaggaaatcttcaggtgtgttttccctcagccagtcctagggtacggcaggtgacacctccaaccctctcggaagcacacccaaggcggagggaatgatgttgggagaatagtagaaatttctccggttccaaaatccgtattgcttccttatgggaaagggcttatttttccttgttttccatctggctattaccattttgatagcctctcttcaggctagataagctgggggtgtcagggacagatgagagaagaaaaaaggtacatttctggtgacaaggcacaaataggcttgtcagggagcgagacgcacatgcaggataagggctctccgtgatgtggaacaagcctgtgtttggagctcagtaaggcggaaagccaggtgggctggagccccaccctttcctgagctctcaggctgaggctcctgaaggcttcaggagcacagcagcaccttgttgacctgcagcaccctgcctgcttggcccggtctcttcacgctgtcgtctcagtgcacaattgaattttcctcctgaggaagttgatggctgctggaacacgcaacgacttcaatacgatgatgaacaaaaagtatcgcaattagacatacctccgcagcactgctgtttgctgtgtcttaaaggaggttgtttggaaaaaaacgaagaggagttgatgacattgttccaagctctgcatatatgggaacacttgaactttttacacagtaggaaaacatttcatttgtcccctgcctatacagcccaagctcctgtctcggtgtttctttctatctttcagcaagtgctgcaaataggcaaaggatggcaaaggaacagcaaccctcccctgtgaatcggggccattcacggttagagtcaccaaacctgtatttcaggggacatctttccagctcccaatctcccactcaggggaggaaggaacggggagctggtgtttcctgggcacagagttctggtttgggattataagaacattccggaaatgatgacggttgcacaataataaatatatttaatgccgcca

SEQ ID NO: 347280 - DNA, 411 bp, Homo sapiens
aagccatccctgaacagcaagcctagtgtccttcattttctttttgcttctagtcaaaccaggcaatgtgaggaacatcattcagcactttgagaacaaccagcagtatgatgccccagaacctgggacacaacgactctcgaccggaagctttcctgaggacctgctggagagtgacaggtagcactggctggatgggactcgccagctgctcgaagagtgggtcatgggcagggctgatgctagggtttaattccagctacttgacccctctccactagcttctaaggctccctttacagaacttcctccccacccccagtatcttcaggagacacattgtgtgccagtgaacaggccagtggaagagcaagcagatccccgacttccagcccaagaactacacacttt

SEQ ID NO: 347281 - DNA, 6564 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacaggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347282 - DNA, 7605 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagctgaggtggcaggcagcaaggttgtccctgcactaccagagagtggccagtcagagcctgggccacctgaagtggaaggcggaacaaaggctacgggtaataactttctccttggagctaaagacaggccaagactggagtgtggaacctgtgagggcagagtcggacccctgcccatggtcacacacacacccacaagctccctcagctgcctggaatggggaggaggaagatctggctctaaagacggggagatctggttctaaaggctggctgtccatccagccttaagaagccacctgtccaggctcctgttcagaatggcagggataaatgcctgtgtgcaattgtgggaggggcagggaagcctggcctgggggtggggacctagtgtccttcacctgatatgcaagcagccacttccccacctcagccgccgctccagtgtcactgtggaaatcggctgaaagagcctcccagattccgcggtggttctctgtgcttcctgcctgtcaggaaccctccacgtccttcctccagctctctctgacaccccttggttgggtcaagggacctccagaggatcgtggcatggatggaagaggggcagggcagggctgtagttcatccagagctggagtcaggcagggcaagagggctgctgcctgctcctttcagaagagcctgaaaccagctcacaatctgtttactcaaggagggggagccactccaatttccccaaatgaaacactgcagctctgccacttctcccttgagttcatcgctcagcatctcccccagcttggggccagactgagcaagtgtcatctagaaggtctcgggagcagggcttttagggggctggcagacagtgagcaaggcccacgttctctgagtttgtctggagaggactgcctggcctgctctgtcaggtggctggggaatcccacaggaacgggaggatagcttcgacttctctgtttgcctcctgatctcattctcttactgtggggacagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347283 - DNA, 4235 bp, Homo sapiens
ctcggtacccagagaggacaaacgcagagaggttctcgcgttgaccaaggaagtcatactcctgcttgctgatcctctctgcgtttgaaacgcagagaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347284 - DNA, 3044 bp, Homo sapiens
tgttggcaggcacctgtaattccagttactcgggaggctgaggcaggagaatcacttgaacccgggaggcgcaggttgcagtgagccaagatggcaccactacattctagcctgggtgacagagcaagaatccgtttcaaaaaaaaaaaaagttttataactcctaagcaccatacacctatcagccatcactgttattagagcaggagaggaatgggggtggctgtggaagatgacattaggggtcctggaatttcctctgtcccttatgtaagtgggttccaagtggtcctgaagatccacatctgtctcgtgctgcactctccatctgcgttgagggtcagggctttgagtcccactctgtcaccctggcccaggctgcagtcacacctgccatccctagtacagacccttctaccttcctttcctcacacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347285 - DNA, 2850 bp, Homo sapiens
tgccctctctccttcctgttctctctcccttccctttccttgtgttttggtctctcctcttcctggtggtggtggtgtcggtgcagctgaggtggcaggcagcaaggttgtccctgcactaccagagagtggccagtcagagcctgggccacctgaagtggaaggcggaacaaaggctacgggtaataactttctccttggagctaaagacaggccaagactggagtgtggaacctgtgagggcagagtcggacccctgcccatggtcacacacacacccacaagctccctcagctgcctggaatggggaggaggaagatctggctctaaagacggggagatctggttctaaaggctggctgtccatccagccttaagaagccacctgtccaggctcctgttcagaatggcagggataaatgcctgtgtgcaattgtgggaggggcagggaagcctggcctgggggtggggacctagtgtccttcacctgatatgcaagcagccacttccccacctcagccgccgctccagtgtcactgtggaaatcggctgaaagagcctcccagattccgcggtggttctctgtgcttcctgcctgtcaggaaccctccacgtccttcctccagctctctctgacaccccttggttgggtcaagggacctccagaggatcgtggcatggatggaagaggggcagggcagggctgtagttcatccagagctggagtcaggcagggcaagagggctgctgcctgctcctttcagaagagcctgaaaccagctcacaatctgtttactcaaggagggggagccactccaatttccccaaatgaaacactgcagctctgccacttctcccttgagttcatcgctcagcatctcccccagcttggggccagactgagcaagtgtcatctagaaggtctcgggagcagggcttttagggggctggcagacagtgagcaaggcccacgttctctgagtttgtctggagaggactgcctggcctgctctgtcaggtggctggggaatcccacaggaacgggaggatagcttcgacttctctgtttgcctcctgatctcattctcttactgtggggacagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347286 - DNA, 5842 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacacttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347287 - DNA, 6013 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctcttttctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347288 - DNA, 4493 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggaggacagcagcaggaggaggacagcagcaggaggtcctcctcctgctgctaggggttggggaggcgggccctgtgtggttgtcagagacaaagagagatggcgatggcggcctggcaaggggtggaggttgggaggagagctgcccagcacgttggagatcaaagcccatgccggtaacaggtgtgtccacgggggccagagaagatgggttatgttcgggagaactgatcac

SEQ ID NO: 347289 - DNA, 2939 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctctttgaggaacccaagcccatggcctccatgactttttcaaaaaggaaaaaaaagagcacagagagaaaaaaagaaaaaagaggg

SEQ ID NO: 347290 - DNA, 2901 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacaggtagcactggctggatgggactcgccagctgctcgaagagtgggtcatgggcagggctgatgctagggtttaattccagctacttgacccctctccactagcttctaaggctccctttacagaacttcctccccacccccagtatcttcaggagacacattgtgtgccagtgaacaggccagtggaagagcaagcagatccccgacttccagcccaagaactacacacttt

SEQ ID NO: 347291 - DNA, 430 bp, Homo sapiens
gtctttgcagtctgagtcatctgttctttcttccattccaggtccaagtatgaggaagacaggaggtaagcaagtctatgatgtggatttgcagctttcaaggtggaaggagtggggttgagctactatgctttccatttctgacaatcacaggggagtccctcatgttgtacaaccatgaaggaccgtggttcctgaaagtctagcactcaggtgtctgtatgaccataacataggggtgatgaggcccacgcccctgatgctcagggatcactgcctggggatgtgggtctgctcctcagtgggaagacaccaagctgccatcgcttctcacagtcccatacctggtggcagcttctctacccagatgagccctttgtctctcttctcacgtctttcccttaaactacctcaagtagtaacagtaatc

SEQ ID NO: 347292 - DNA, 168 bp, Homo sapiens
ttctgactccaggaacagccatgaactggggccctgccctgaggatggtgagtgaagccaggtccctctcggttcctaccattgggggagaagtctgccaactcgtgaggacacatcactaagcagtgagagatggtggttctgagagtggtttccccttgagtgaaa

SEQ ID NO: 347293 - DNA, 490 bp, Homo sapiens
ggacctccctgagtaggtaacctcccaccaatccctggtgagaaaaagatctgtggacagcctgaaaccagcactggagttcaccccgaaagtacaatggtttccagacccttcccatggcactgctgtcagagattcacttctctctgtcagaaaggttctggcagttgagctcaaccccaggcatttctatttgttctcttcctgccccagattcctggtgtgaagccatgaagaagctccgggaggaaggccccatcatcaaagagatcagtgacctcatgctggcccgggtatggctccaaacttctccctcttggcaaggaggagattgggggaggcagggtctcattacccaaggccagagaatttggcaaaggcaggggtctggtcccaggcaggggtttgatgcctggccccgtgtccattctgcctcttcagtttgatggccctgcccgagaggaactccagcaagtggctgcacagttct

SEQ ID NO: 347294 - DNA, 319 bp, Homo sapiens
tgcgttgagggtcagggctttgagtcccactctgtcaccctggcccaggctgcagtcacacctgccatccctagtacagacccttctaccttcctttcctcacacagataaacgggccttcttcatcatctgcacctccaagctgggcccaccccagatctatgagctggttgcattgacgtcatcagacaagaacacgtgagaattgattgaggggttacccgtaactgtggtccctttcggaccagggtggtgtttatgaggacagtgggtagcaaggccaggtttgggccccaaagcagtccctggacaaggggtt

SEQ ID NO: 347295 - DNA, 253 bp, Homo sapiens
atctccctggagtgtgcagacctgactgcttctgctccacacttctgttttttagcctctgagagtgaagatccctgagatgctacaggctgaaattggtaagttggctcattggtcggtaagtctcttcttggtagctttcttgtcctgagctctcaggaggctccagaggacagaagggacatagtccctgtccttgggcaaccgtcctgtaatagaggaaaagacccatgggatgattgctccagaacac

SEQ ID NO: 347296 - DNA, 119 bp, Homo sapiens
tatatataatatataaaatatagatatggaaatgactgttctgctgttaagataatgtatactcttttattttcttcctttcatggttaagattttttttttaagaaaagttaaatatc

SEQ ID NO: 347297 - DNA, 6588 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347298 - DNA, 6634 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagtcagagcctgggccacctgaagtggaaggcggaacaaaggctacggggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347299 - DNA, 2806 bp, Homo sapiens
attaccgaattcgaagccccggtaccctgtgccacttcagcaaatagcttctcatccctgttttctgtagcagcaactaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagggaactgcttttatgtcagcatgccatcaggacccccggactcaagcaccgaccactcagaggcacccatgagcccccctcagcctgacagcctccctgcagggcagacagagcctcagcctcagctgcagggaggcaacgatgatccaagacgccccagccgctctcctccaagcctggccctcagggacgtgggcatgatcttccataccattgagcagctcactctcaagctcaacaggctcaaggatatggagctggcccacagagagctgctcaagtcccttgggggagagtcatctggtggcaccacgcctgtgggcagtttccacacagaagcagctagatggacagatggctccctctcacctcccgctaaggagcccctagcttctgactccaggaacagccatgaactggggccctgccctgaggatggctctgacgcccccctggaagacagcacagcagacgcagccgcgtcaccaggaccataaccgtacaaaccaccaaatcctctgcgtccccactcctccttcagggactggcctgagaccggggcacagggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347300 - DNA, 1211 bp, Homo sapiens
aaccaccaaatcctctgcgtccctgaaggaggtaggggggatcccaacactcctccctgtggaggaggcagttagggaaactaggatccagccaaggcccggggggagacccgcatgttgcttggtctgctcaagtcggagtcaggtttcagtgtcttttccctcccttagcccaaccctccaaggcctcatgtctcctaagcatgctgactgcatccgaaaggcccccactcaccatggtctgccctcaccccacatatgtgtgtacacgcgcacgcctgtatgtgcgctgccctcagacatgcaagtgaaaggaggaggcttctgtgtaaatgcactttcttcctcccctctttctccataagaccccaggcagaggtgggtgcctcccctcccctctttgtcactttggtttcctataaatatgtatgtatcgtatgtgcatctttgctattgtaaataactttgaccttttttgttcctgttcctgaagtgctggaggcagttatggaaggagctgcttagggaagaggggtttcacttgtatctccttagttaacaacccagttccaggatcgagcctaaagcgggagccaggcctgagtgttcctgtccctgtgagtgggaaggtcttctggctccccatcccacctggctccagagcctgccctccacagcttgctgccaagctactccctccctccctggacttctcatcttcacaagatggggatcatgggggtttcttaccccacctatgtccccctcttccccaccctgtccctgtagaaaaccagtgaagcaggtacggagctgaggactgggccccaggaggtggggacaggggtctgaatgccgagtccctgaattcacccaggaccatccaaggggccaccgcagcattggccccatcaccacgtcctcacccaactctccctgatgaatagaatatacacactgtgctaggtgtatatatacatatatatatatataaatatatatataatatataaaatatagatatggaaatgactgttctgctgttaagataatgtatactcttttattttcttcctttcatggttaagattttttttttaagaaaagttaaatatccttcagtggtggtgtgtgtgtttcttggaatcgctgtgataaaaggtacggtgtttgttccctgtaagactggttaggattggatagtgggaacc

SEQ ID NO: 347301 - DNA, 4919 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtggcacctctgagcatgagaagctgtgccgggcccgggaccagtgccgggagattctcaagtatgtgaatgaagcggtaaaacaaacagagaaccgccaccgtttagagggctaccagaaacgcctggatgccaccgccctggagagggccagcaaccccctggcagcagagttcaagagcctggatcttacaaccagaaaaatgatccatgagggacccctgacctggaggatcagcaaggataagaccttggacctccacgtgctgctgctggaggacctcctagtgctgctacagaaacaggatgagaagctattgctgaagtgccacagcaagactgctgtgggctcctcagacagcaagcagaccttcagccccgtgctcaagctcaatgctgtgctcatccgctctgtggccacagataaacgggccttcttcatcatctgcacctccaagctgggcccaccccagatctatgagctggttgcattgacgtcatcagacaagaacacatggatggagctcttagaagaggccgtgcggaatgccaccaggcaccccggagctgccccaatgcccgtccatcctccacccccaggtccccgggagccagcccagcagggccccacacccagcagggtagaactggatgactcagacgtgttccatggtgaacctgaacctgaggagctgcctggaggcactgggtcccagcagagggtccaagggaagcaccaggtcctgctagaggaccctgagcaggagggcagtgcagaggaagaggaactgggtgtcctgccttgcccttccacatccctggatggagagaacaggggcatcaggacaaggaaccccatccacttggccttcccaggccctctgttcatggaagggctcgctgactccgctctggaagatgtggagaacctgcgacatctgatcctgtggagcctgctgccaggtcacaccatggaaactcaggctgcccaggagcccgaggacgacctgacacccacaccttctgtcatcagcgtcacctctcacccctgggacccaggctccccagggcaagcaccccctgggggtgaaggggacaacacccagcttgcagggctggagggggaacggccagagcaggaagacatgggtctctgttctctggaacacctacccccaaggaccagaaattctgggatatgggagtctccagaactggacaggaatctggctgaagatgcttcaagcacagaggcagcaggaggttacaaagttgtgagaaaagaggtaaaataaatgggagtgtccagtggggagacaagcacccttgctaggtgagataagtcttccgaacagctgcttc

SEQ ID NO: 347302 - DNA, 3700 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccagggtgtagatcaaagcccaaagcctttaattattggcccagaggaagactatgacccgggttatttcaacaacgagagcgacatcatattccaggatctggagaaactgaagtctcggccagctcacctgggggtttttctacgttacatcttctctcaggcggaccccagtccactgcttttttacctgtgtgcagaagtttatcagcaggcaagccccaaggattcccgaagcttggggaaagacatctggaatattttcctggagaaaaatgcgcctctgagagtgaagatccctgagatgctacaggctgaaattgactcgcgcctgcggaacagcgaagatgcccgtggtgttctctgtgaagctcaagaggcagccatgcctgagatccaagagcagatccacgactacagaacgaagcgcacactggggctgggcagcctgtatggtgaaaatgacctgctggacctggatggggaccctctccgagagcgccaagtggctgagaagcagctggctgcccttggagatattttgtccaagtatgaggaagacaggagcgcccccatggacttcgccctcaatacctacatgagccatgctgggatccgtcttcgagaggcacgaccttccaacacagctgaaaaggcccagtctgctcctgacaaggacaagtggctaccgttcttccctaagaccaagaagagcagcaattccaagaaagaaaaggatgccttggaggacaagaagcgaaaccctatcctcaaatacattgggaagcccaaaagctcttctcaaagcacatttcatattcccttgtcccctgtggaagtcaaaccaggcaatgtgaggaacatcattcagcactttgagaacaaccagcagtatgatgccccagaacctgggacacaacgactctcgaccggaagctttcctgaggacctgctggagagtgacagttcacgctcagagattcgcctgggccgctctgaaagcctcaagggccgggaagagatgaaacggtctcgaaaggcagagaacgtgccccgctctcgcagtgatgttgacatggatgctgctgcggaggctactcgcctgcaccagtcagcctcgtcctctacctccagcctctccaccaggtctcttgagaacccaacccctccattcactcccaaaatgggccgcaggagcattgagtcccccagtttggggttctgcacagataccctccttccccacctcctagaggatgatctgggccagctgtctgacctggagccagagccagatgcccaaaattggcagcatacagtgggcaaggatgtggtggctgggctaacccagcgggagattgaccggcaagaggtcatcaatgagctgtttgtgactgaagcttcccacctgcgcacactccgggtcctggacctgatcttctaccagcgaatgaagaaggagaacctgatgccccgggaggagctggcccggctcttcccgaacctgcctgaactcatagagattcacaattcctggtgtgaagccatgaagaagctccgggaggaaggccccatcatcaaagagatcagtgacctcatgctggcccggtttgatggccctgcccgagaggaactccagcaagtggctgcacagttctgttcctatcagtcaatagccctagagctaatcaagaccaagcaacgcaaggagagtcgattccagctcttcatgcaggaggctgagagccaccctcagtgtcggcggctgcagctgagagacctcatcatctctgagatgcagcggctcaccaagtacccgctgctgctggagagcatcatcaagcacacagagggtagcacctggggaggggctggcatcacaggcagtgggcctcgtgccagaccctcattctgacactgctttgtgaccttagcaagtcactgtgccttgtggtctttggtgtcttcgtcctttttctgttgtggggtgtttcag

SEQ ID NO: 347303 - DNA, 1797 bp, Homo sapiens
aattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttttcttttttcttttcttttctttttttttaaagcgggggaggggaagaggggctgagaaaggaaatcatgttcactggtagaagtagagtggagcatcagttaccagggtcctgagagctggaggagaaaggattctatcttcaagttgggaggccctcctctcaccttgctcaaaaattgcaagcgattcaatcctgatcaagacaccaaagctacaggattctggaaccgtggagacaccgagaaaccatgagtgtaaggttaccccagagtatagacaggttaagtagcctgtcttctctgggagattctgcaccagagcgcaagtccccttcccaccatcgccagccttcggatgcctctgagacaacaggtctcgttcaacgctgtgtcattatccaaaaggaccagcatggcttcggcttcacagtcagtggggatcgcattgttctggtgcagtctgtgcggcctggaggtgcagccatgaaggccggtgtgaaagagggcgaccggatcatcaaagtcaacggcaccatggtgaccaatagctcacacctggaagtggtaaagctgatcaaatctggcgcctatgtcgcactcaccctcctgggctcttcaccttcatccatgggcatctctgggctccagcaggacccatccccagcaggagctccccgaatcacgtcagtgatcccctcaccaccacctcctccacctctaccacctccacaacgcatcacaggacccaaacctctgcaggatcccgaagttcaaaaacatgccacccagatcctcaggaatatgctgaggcaggaagaaaaagaattacagcgtatctgtgaggtctatagccggaaccccgccagcctactggaagagcagatcgaaggtgcccggcggcgagtcactcagttacagctgaagatccagcaggagactggtggctcagtggacatacttccactatatggtgacaccagccagagaccatcagaaggccggctctctctggattcccaggagggggacagtggcttggactctgggacagaacgctttccttccctcagtgagtcattgatgaatcggaactcggtactgtcagaccctgggctagacagtcctcgaacctcccctgtgatcatggccagggtggcccagcaccacaggcggcagggctcggatgcagcagtcccctcaaccggtgaccaggtgagtgatctggagccaccctgcagttttccttttctcagaagtgagatttggaggcatgggtgttaccagtacatcgtcttggatca

SEQ ID NO: 347304 - DNA, 489 bp, Homo sapiens
gatgtcatcgtgtatgatcttgtgttcaccttgttcttcccattttctcctccccctgtccccacctcctgccctctctccttcctgttctctctcccttccctttccttgtgttttggtctctcctcttcctggtggtggtggtgtcggtgcagctgaggtggcaggcagcaaggttgtccctgcactaccagagagtggccagtcagagcctgggccacctgaagtggaaggcggaacaaaggctacgggtaataactttctccttggagctaaagacaggccaagactggagtgtggaacctgtgagggcagagtcggacccctgcccatggtcacacacacacccacaagctccctcagctgcctggaatggggaggaggaagatctggctctaaagacggggagatctggttctaaaggctggctgtccatccagccttaagaagccacctgtccaggctcctgttcagaatggcagggataaa

SEQ ID NO: 347305 - DNA, 385 bp, Homo sapiens
aagccattcctgggaggtttcaagcccccaaaggactattggaaaactgagacttcaggctggaattttagccatcctaagagttctgaacctggaatccatggatagaattctggagaccatgaaccagagctggtaaatacatctttatttaaattaacctttaacaccaagtgcggtggcactcacttataatcccaggtactttgaggcctccagcaagacccctgtctcaaaaaaaaaatcaacctttaaccaaaatccagcattttcttcacttatgaatgtaggtgatattccatctcaacacattgcagtcactggaaatatctcaaaatagcatttatttatttattttatttttattttattttttgagacagag

SEQ ID NO: 347306 - DNA, 501 bp, Homo sapiens
tcccgcctactcggggggctgaggtgggaggattgcttgggcctgggatgttgaggatgcagtgagctgtaattacaccactgcactctttctagcctgtgggacagagtgagatcctgtccaaaaaaaaaaaggaaggaaggaaggaaagaaggaagaaaggaaagaaaaagaaaagaaagtttatttttgggacatgctaaattttaaatgtgtttcggacttccaagtagaagggtctaatagtcaattaaatatatggatctggaacttggtagatgatgtagttatgtcctaacattttaacttgcatattaatattatatgtgctgcacgaatggtatctgttttgattttggcaatgtcacagattatcaacaaaagtaattgttaaaaagaattagtcaataagttgttccattatgttgctttatgtcttcctagaaaattctttgaaaaatgcataaaaggaaatattaaaatcagccaaaacaaaatatt

SEQ ID NO: 347307 - DNA, 597 bp, Homo sapiens
tgtcgaggctggcttatgagtggtagttgcatccatttcttttttcgtgggagtgttctttcatgttcagttcttctatgttttggtttaaattttaacccaagaatgttaggctagggtattttaatcatatgtcattattgcttatgatttaagtttgaaataaacaccctgagtttattgttcttaaagctaaaaaacaatgtagaatgaaaactggaaacgcttatgatttaccaggacaattagaaaataatggccttttcagagtatttctacaaatagcaaatgcacaagattgttgttgtcacagtgtttttctgaaaatgtcccataatccaaatgccagtaatcccagccggcctctccctatcgtcctacatgttggaaccactctccaccattacacgttctctgtaaagcattcctttatttcattactgtttaagcatggtcaggaaagaaatcatatgtagtgtagaatgattgctcccaaagctgtctctcacctcctcacccctagtactcactgtcgcagctgctcatcttagtgcttcgcatataggaacttgtttagttctcacgcaacccttagag

SEQ ID NO: 347308 - DNA, 412 bp, Homo sapiens
cacagccctccagtagagggcacacgagagcaggctatctgtggagatagcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaataaaaaaaaaaa

SEQ ID NO: 347309 - DNA, 502 bp, Homo sapiens
agagaagcctgtgttcttggctgttccattttggagtagagtttctgtccagctgatctggaaaaggggtgatgaaaggcatgggtcttggtttaagtatccaagcttttgcagtttttactaagtataatagatttctttgaataagtggtttttttttcatttgctatatacaattttctgaaaacttcaatgttgtttttatttataatactcactagtttcactagggagtggacccatggagctcctcacagtgatatcagaagaggagctcccattttcctccctgttgaagtacatataaagagaatcacatagaggtacttttgtgatatctgcttcttttactgagcattatgcatctgagatactattatgctgttatgtatagcaataattttttctctttcattccaatataatacttcatggtatgaatacgccataacaagtcattgttctcttcagtgtcatttggatcattttcagtttgggggta

SEQ ID NO: 347310 - DNA, 408 bp, Homo sapiens
aggttatgtgactcttctgcttgtgctcttcccatgtgggtcattgtgacatattgctctgtcacacacccaggtgaggtaaccatactgcctaggtcctgcctacagaggacattgtgacatccctgcacccatcacacaggtctccctctgatgccgagccgaagctggactgtactgctgccatctctgctcactgcaacctccctgcctgattctcctgcctcagcctgccgagtgcctgcgattgcaggtgcgcgcagccatgcctgactggtttttgtatttttttcgtgaagacggggtttcgctgtgttggccgggctggtctccagctcctaaccgagagtgatctgccagcctcggcctcctgaggtgctgggattgcagatggagtcccgttcactc

SEQ ID NO: 347311 - DNA, 407 bp, Homo sapiens
tgctgttatgaactgaatataaatgtttttgtgtggacatgtttttagttctcttggatagatacctaggagtgaaatttctgagtcatatcttaactctatgtttaatcgttcaagaaactctcagattgtttgccaaagcagctgccctacatcatacactcagtgtatgatggattcacgttcactgcatccctgccaacacttgttattgtgtctttctagtaatatcattctagtgagtacgaagtgttatctcactgtacttttgatgagcacttccctgatggctaatgatgttgagaatattctcatgtggttattggccatttttatatcttgtttagagtgatgtttattcaaatttgtacccattttcaaatcagtaaacatttgcctgtctatga

SEQ ID NO: 347312 - DNA, 716 bp, Homo sapiens
caattctcctgtctcagcctcccaagtagctgggactgcaggcgtatgctaccacgcctggctgattttttgtatttttagtagagatggggtttcaccctgttagccaggatggtcttgatgggaccagcgtcatgtatgccgtctgttattgccaggagcatcatgatgtgaggcgtggctgtacgtggaggctgacagtttgagggtaggggctctcctttaaatagaggttaacatgcataaaaattcttggaggggacataatttatatacaataaaatgtcccccttgtaagtgcacagattgaggatgtctacccccatttcgttcagccccccagagggtctgcttgtgccctctgctgtcggcccacagccctggacgggaaggtgttctctgggccgcctctcgccgtcggtgtggatctgtcctttggagcgctcaggtcgctgaaaccccagttgtgtgctccctggtgtccggcttcctactcagagtacttggaggggcatcgtgtgcaacacgtgtccacagtttgttatttttatggggaatggtttctgtttggatgtacgctatacatttgccagctgaggagtctggcatgtttccagtttttggctattacgaataaagcttctttttgtacatttgtgttcaagcctttgtgcgaacatacgtgtagacgtccatttcttttgggtaaatgttag

SEQ ID NO: 347313 - DNA, 348 bp, Homo sapiens
tgaccttggtttctaggtgtggttcttgagctgagcaagtcacataacctcttcagacctcagttttttatatttcgaacagaagaattgtactaagaagattgtctaagggaccttctagtgcaaaaatgccattttattattagactttttgtgtttatctttttttttaaggaatatgaatttacctatgttatttccagaaattaatttcttttttttttgagacggagtctcgctttgtcacccaggctggagtgcagtgagccgagatcacgccattacaatccagcctgggtgacatagtgagaccccatctcagaaataaataaataaataaagtaaaaa

SEQ ID NO: 347314 - DNA, 521 bp, Homo sapiens
gaaggaaagaaggaaggagagagagagaaagaaaagaaagaaaggctgctttaggactaagaggtaacgggagatagctgctttaggactaaggtaactggagatatcagatatcagaggtcatatgtgggtagatggagtagttccaactcaataaaagtagagagttcttgctgagcccctctggcattcagttaaataagattccagaaaagcaacatcttaaaaataagaactacacccttgaaaaggagccctgccctaaaattacaaataaagctagaagaggatacctactcctaacaaagtactgaaacaagcctaacaggttcaagatcctttagtaatttaattgcctgccagaacaaagctcataacttttaaagaaaggtaacataattcataaccctacaaaatgtatcacacacaagtacagcacataatcaaaactctctagacatgtgaaacaggaaaatgtgacccaaaataaaaacatggtaaccagatattgatattagcag

SEQ ID NO: 347315 - DNA, 493 bp, Homo sapiens
ggccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaa

SEQ ID NO: 347316 - DNA, 920 bp, Homo sapiens
ggtcgaccttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaaaaaaaaaaaaaaaaaaaaaaattttgggggggcggggcccggaaaaaagtttttaaaccccaattgggggggggggggggccccgggttagggggacctgccaaggggcgcccaggaggaaagccggccagcaccaggggtctgtttcccccccaacaaaaaaggccggcgcgggaccgaggcgtcgcgaacacaccgaaggggtctggggggctccagggctccaacacgggaccgaggaatgtaaattgaccccgcgcgggaaaaaccaacacggacaccagaaacacagagcacgagaacaagcaaacagtggatatcataccatcctagaggcaatagccgacaagcaaccacgacacagacgggcactgagcaagcacgcagacgagagagacgagggacgaccacaccacagagcagagatagcgtcccaaccgga

SEQ ID NO: 347317 - DNA, 655 bp, Homo sapiens
ggccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaaccccaaaaaacaagattaccatgcaagtatataagaagatctactctgtattaaggaacaaaactcgggggggggcgcgggcacccaattcgccctatagggatgggtttacgcccccctcctggccggcgttttaaaacctcgggcatgggaaaaaacctg

SEQ ID NO: 347318 - DNA, 455 bp, Homo sapiens
ctgcatatgtatgtttttaagagtctggaaatagtcttatgactttcctatcatgcttattaataaataatacagcccagagaagatgaaaatgggttccagaattattggtccttgcagcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaa

SEQ ID NO: 347319 - DNA, 541 bp, Homo sapiens
cttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaa

SEQ ID NO: 347320 - DNA, 387 bp, Homo sapiens
ggccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagcagtcacgccgtcgtatcctgtccatcagcaggctagaatgccaacttatgtcctgctct

SEQ ID NO: 347321 - DNA, 791 bp, Homo sapiens
ggccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaagtcatgcgtgtcttttgtaaaatttattcctaggaaattgacactattgtaaatggtatctttaaaaaatccttgtgttctgtttagagctggtatatatttttgtatactgattttgtgttgggcaacattgctaaacttgcctattctgttggtttatccctacgtccttttggattttctccatacacaatcataccacatgtaaataatgataattctgttttttccttttgaggctttgtactttcatttctggtccttatgacactggccagacccctccagtacaatg

SEQ ID NO: 347322 - DNA, 552 bp, Homo sapiens
  misc_feature (500)..(500): n is a, c, g, or t
  misc_feature (502)..(502): n is a, c, g, or t
  misc_feature (505)..(505): n is a, c, g, or t
  misc_feature (513)..(513): n is a, c, g, or t
  misc_feature (517)..(517): n is a, c, g, or t
  misc_feature (525)..(525): n is a, c, g, or t
ggccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaaaacaaantnccnaccccccncctnccaatctnacctctttttaaaacaactaaaaaact

SEQ ID NO: 347323 - DNA, 330 bp, Homo sapiens
aacctaaaaatctgggctgacttcttgaaaaataaaatgtttatgttgtaaacaaggttgaataatgcacatgtgttcatcacatccatgaacaaagcctctaacatcagtgatactcattaataagggtgggataatgtctgccatcaacatgccaattttctatcgatttagttaattagaaaatcggagactggcttctttttaagtttctcagatcaatcataccagagtatcttttcttagcggtgtcttgggcgggctccacatcctaatgtcacgttcagtcatttcttctttttttttgagaacaagtcttactctgtcacc

SEQ ID NO: 347324 - DNA, 947 bp, Homo sapiens
ttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttctctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcc

SEQ ID NO: 347325 - DNA, 301 bp, Homo sapiens
ttgcagtgagccaagatcgtgccattgcactccaacctgggcaacaagagcaatactccatgtcaaaaaaaagaaaaaaaaaaaagttcaagtggattgtttaggaagcaatcccagaaagtatctgcaggggattggggaggtgtgacaggaagaaaagtgcccatgtggggaacagaatcaaggaagttactgctgtgggtaactggtgcttaatcaccctgggccctctaggaggcagtacagcacacgtctcagagttatcccactgcagatgcataggacactggtcgacgcaact

SEQ ID NO: 347326 - DNA, 324 bp, Homo sapiens
aaacatagtcacataaaacaaaaacaatctattttgctcacaaatctgcagtttggacagggcttgagagggacatcactgctcagtggaggttatgtgaagtctccaccgagatttaaatggctgggggctaggatgatctggaggtgtttttcactcacatgtctggcacttgggctgagataactgagacgctgaccacagttgggactgtcacaggagtgcctgtggttggcttatacatgtattttaagcttcatcacagcatcacagcatcacatcctcaaggtagtcaaacttctttttgttttttttttgagacag

SEQ ID NO: 347327 - DNA, 519 bp, Homo sapiens
tcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggcaatgttatcaatccagttctagaagtttatcttacagatacgtgcatgtttacaaagccatgtatacaaggatattttatacagcactatttgtagcagcaaaaaactggaaacaagctaaatgatcacccatgagcctggctgaataaattaaggcacatctatgtaataaaacatgatgcagctgttaaaacaacaagcagctctggatgtatccccaagatattttaagagaaaaaagcatggtgctg

SEQ ID NO: 347328 - DNA, 405 bp, Homo sapiens
tgcactccagcctgggaaagagaacaaaaccctatctcttttaaaaaaaaaaaaaagtgtgttgtattcatttattccacatgcttgagaagtctactgatacctgattatattgaaattacaaagataacattatgggcagcctatgtcagaaccttagcaaaccagtgtttttacaaagatactcacctgtagcaccaatttaaactattttctgaaaactgtattcaaaaattccttgttaaaactactgggaaataatgagacctccaaaggaggctttcctttagctggaaatatactgaataaaaaacaaaaacttcttttttttttgagacggagtctcactctgtcgcccaggctggagtgcagtggtgcgatcttggctcactgcaagctccgcct

SEQ ID NO: 347329 - DNA, 358 bp, Homo sapiens
tctcacaaaccatccattgtgactttgccaggggatcctgatcttaagacaattaaacaattaaaaaagatcagttaaaaaaaaatccttcttctctgctccttatgctgttggctgcttaagctgtttgctttcatcctcagctcttgtgtgaattatacatgtttttgtaaactcaaacttaaaacccagtatgtctttagatagctttttgcactgcaccctttaatgtgggttatttttcacatgcactggggtgattttgcttgtgcatagaagggcggtggcttgcttcaagtatcggttaattgcacttacattcattggtttgttcctgttacaaacagaaaagaaaaaa

SEQ ID NO: 347330 - DNA, 369 bp, Homo sapiens
ggttccagcactgtctctccacgtctcaaaaaaaaaaaaagaaaagaaaagaaaaaaaagaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgaggcattttgattcctcctcctgctgcccatctataccaagcccagaaactgtctggaatatattttagtttcctgaatgacaccaagaagtagaacagtcttttcaaaaatgtattttaataagctgaatctcaagaatctgatctatagtttgctg

SEQ ID NO: 347331 - DNA, 599 bp, Homo sapiens
agagcgagaggtctgggctgccttccaagccagccagcctgccccagatggccgtccccagccgccaagcagacagtctcgagtggacctgcatctcccagcagatgggatatgagcattggcagtgccaggctccccaccaaggcaggaacagacttggagctgggctttggcactgcttgtccaaaccccagagagcctggacagggtgagcgccaggccagggctgccctgtctcaggtccctttggcactgtctcacccaggacactggggacagagtggggatggcaaccagccaggaactgtgtggcacccccccacaaggcccagtggttctcattggcctagaacacgtgatttttgacaggctttagttctgatagggttagagatttgggtttttattttattggtttttcttttttatttaaaaagtaccaaacgctcattattaagaacttagacaatacataagtatgcaaagtagaaaaaggaaagtttcattagtgaaaaaagcaagtgtgaccccgtttttgttcaataggtacatctgactgtgtgtgtgtctgtgtgtatttgcttatttatttttgagac

SEQ ID NO: 347332 - DNA, 825 bp, Homo sapiens
ttggtggaattatggcaaataatatgctatcccacagtagaatacttggtaaacattttcagaaattaatttgagtcaggatttcggtctcttgaaacccccttcagctggtctgtagtgtgtaatatcagtggaagttattctaatggcttaatttaccaaaatatcaaatccaggaccagttaaaagccatttattctcctaaataattgtggcaacgtagtttttttaatgcatttagaatttcagagtagtcaggtatgatcattcagaaaaaagtaatttaaatgagttatgaaggctatatttaatatatcctaatatgagaggcttaaatctaaaccagtgatttctaatttttttggtggggttttataattctctttgagaattcaatatacacaatttctgggggtttgtgaaattctcctactctcctgttggcacactaagggcccagaggcccagaaatgtcaatgtgaatctattccattaatctagagtttaatgaatatagagttcagtaaagttgacaaatcacaaaatgtcatagctcttattggaagctacagtcttcaggctgtggaattggtgggactttatctggagttgctgcagtgggaagctgaaaagcattgggaaacatgtctgatctgcctggacttcctcaaggagctgggtccctggaaacttttaggaagaatcataccactctcacaggtctcctgtgttgtgggtgaaatcctgtgttgaaggctagggaagtgtctgaggacacttagcaagttgaggctgctgaagaactttaaactcatgtaaacatgc

SEQ ID NO: 347333 - DNA, 771 bp, Homo sapiens
ttggtggaattatggcaaataatatgctatcccacagtagaatacttggtaaacattttcagaaattaatttgagtcaggatttcggtctcttgaaacccccttcagctggtctgtagtgtgtaatatcagtggaagttattctaatggcttaatttaccaaaatatcaaatccaggaccagttaaaagccatttattctcctaaataattgtggcaacgtagtttttttaatgcatttagaatttcagagtagtcaggtatgatcattcagaaaaaagtaatttaaatgagttatgaaggctatatttaatatatcctaatatgagaggcttaaatctaaaccagtgatttctaatttttttggtggggttttataattctctttgagaattcaatatacacaatttctgggggtttgtgaaattctcctactctcctgttggcacactaagggcccagaggcccagaaatgtcaatgtgaatctattccattaatctagagtttaatgaatatagagttcagtaaagttgacaaatcacaaaatgtcatagctcttattggaagctacagtcttcaggctgtggaattggtgggactttatctggagttgctgcagtgggaagctgcctggaaacttttaggaagaatcataccactctcacaggtctcctgtgttgtgggtgaaatcctgtgttgaaggctagggaagtgtctgaggacacttagcaagttgaggctgctgaagaactttaaactcatgtaaacatgc

SEQ ID NO: 347334 - DNA, 986 bp, Homo sapiens
gcaaatgaattctcagaggaagtggtctatgtctgcatgaactgctctcaaaccaacaaacaggcttctcttggcaactgactcgtgacaaaggggcaggggttacaaccattcaacaggaatctgggaccgtgactaattccaagcaagggcagaaaaccctgcacttgggcagttcctggagccagcctactgcttccaagcaaggtggcaaggacattcctgagctggtttgcaggaaacacaggaggtagctgaagacgccgtgttccctggggcctgacctcaccgtgcagtggccacgcacagagaggagagacccacacatgctcttttctgcagaaacagctgaagggacaggcaccctcagtgcgtgagcccaagcccctccccactcacttggtgaccacagcaatcttgactccgaagacccctgtctgttttcgggacggcatcctcttcaagctgaacttcctgctgttgaacttgaccgagagctttacttcgatctacagtggggagaaggggcacagtcctctaatccttctggtcctcatagcccaaggtcccaaggacccctgggagtctcatcaaatatttccacccccaaggcatgcagaggtctcagcatgaggtggagccgcccctcggggaagcccctagtctacttcagcaagagccaggattgttgaagatgatgtaaacgactggtttctgcagaagcacctcctaaaatccccgctgcttctcttgcttgcttacttttttttaagatatgggatcttgcaatgttgcccaggctgtaatcaaactcttgggctccagtgattctcctggttcagcctccagagtagctgagattatagtgtactgtgaccagctttctcttagtaacaattaaaaattaagtaggaaagacagaataatgtaagaaaaagccaagaatctcaaatattaacattttaccatttatacccggaaaaaaa

SEQ ID NO: 347335 - DNA, 526 bp, Homo sapiens
caatggacaattccaatacctccacacaggacactagagtaagaatccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtgggggtggggcgtggtgtttagacacagataggagtccagggtatgactgatggaggccccggcccacgtgaccagcaaggtcagaggcccagccagattccatcctagggaggcaaatgaattctcagaggaagtggtctatgtctgcatgaactgctctcaaaccaacaaacaggcttctcttggcaactgactcgtgacaaaggggcaggggttacaaccattcaacaggaatctgggaccgtgactaattccaagcaagggcagaaaaccctgcacttgggcagttcctggagcc

SEQ ID NO: 347336 - DNA, 1025 bp, Homo sapiens
gatttaaacaataaattgtggaatcacaaaacaaagacaagagaaaaaacaaacaggtagctaccagcgtgatataaagacgagctttcctgccagaagagatgcatagaaatacaatgagctatcttcaaatgtgccgagttctctagagctagaaaaattccaatagactttcaatacctcttgtcaaaacacgatgaggaagattcctatgttaggaaggtgagagaaggccatggctccaagacacttcccaacgtctttctagaagtttttgcaggaaggggttgaaaaggatgttttgtggtggcaccgggctagaagaacaaattgactaaatcttaaaagtaataaagaacttcaaacaaaagcacatcatgaaaaatgagtatatttgtcttatttcataagaactatggagtacaaagaagtctagaaatcttttttataatggcttggccttctcctatagagagaaatattaggtaaattgcttttctatgtgtcactgcagagtataaataattatatgaaacgaaagaataactgtgggaaggaataaaaatgtgtgcgaggtctctggtgacagagtaatggctcgccgacatccacccactcttccccttgatggccagtgcctccatctacccaagaagcagcttgatttgtcaggaaattatgctctgaaagggtatttcaaatggcccaccgcccccacgctcctccactgtgtcctctggaaatgacttattgactgtcacaatctttgctggacagctgcccaccatacagtgttctcaaggtgctgtctgcaagaggagcagactacactagaaaaatggtccaaatgacagcatcatttttacttaatacttgaatcgatttttctctttttcccctgaagcattttctctcttgctatctttcctcataaagcccttgagacttgtttgggaaatgttttacaaataaggaaacgtatacagggaaattaggcatcaaataagtggaattcaactctctcc

SEQ ID NO: 347337 - DNA, 763 bp, Homo sapiens
aaaaaaaaaggcttgtgaaaaactaacacagatgtcacatggctctaagaaaatcctttaattctatttttcaagtctttatttaccaactttttttcaagtttttttgcctttagaagttagacagattcacctctagaaagtacactgctacatacaaaaagtgacaagcctgataagatgaaggagtcagaaacattctaaaatcaaaataaaatgaaacagaaaaacccaacagccaaagactatggcacatagcattatatacagagtgacctttgggagcctcaccactttacaacacagtgccataattattgttaagaatggtaattctgagttatacagacaggagttggatcatgatgaagatagtctttaagaaagtaggcagtgaataataccatttcatgaaggttttcattctaattttcgaaagtaagaaaaattggtacttcaaaggggaatatcaaatatcttaaaatttacttacatgaaactgtatctcattaggatttgtaaggatttataatgcatttgtggattaaggaggtagaatgtggttctggcaatgtggatcatatgagatcttgaaatcttgattgtctcaccaatcagtttggctactcaatgcttctgggctagcctgtcaattgaccttccatgggaatgaactatgctaattctcaatcacatagaagaagcagaatagaagcaacacagttattttagcagcaatactaacattagtagtagcagcagc

SEQ ID NO: 347338 - DNA, 659 bp, Homo sapiens
ctcacttagggaatttggccctcaagcccagaattcggcacgagagattttggctcctttttgcacccttaaatgtaaaaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347339 - DNA, 714 bp, Homo sapiens
aattcgtcgcgagtgagtcaacggacgtgtattcctggctactcaggaaggcctaatgaaagcggatgcgatagctgtgagtctgtgagtgcgaaaagtgattgggtgtcatagagtgatccagttacatctgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagatatggagatttgactttggaaataaaaattagaaacggagtagaatgaacgagagagaaagaaggaatggtaaagatctccatgaatttctgcaatacggaaggctagattgaaacat

SEQ ID NO: 347340 - DNA, 3251 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtgggtgagttctggtcccactgcctggcagtcgtcgctcgcctggctttctgcgctgggagagctcctgttttccgccccaacttcgttctcttcttgaaggccgctctccttaagcacgtaacccggctactttccggtactgcgatctcattggctgcatgttctgtcagttccagaagctggccaatgagatgccgctgctggcggccttctcgaccccgtggacccagaggttcccccgtgggatcggagcagttagaaggggaggagagggaagattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347341 - DNA, 2935 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347342 - DNA, 3869 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcaggtaagactattgaatttattttattcaagtagattttttttcctgtaagattttgtggggggaagccttgttactctttttaagtttgtatattactagcccatgcagaaatttttcttaatttgaggtagaatgcattttaggatttgaataaagaacagggtaactactttaaaaacaaggatggaaaaaaagatgatgtattcagaattctgtacaagtaattagtttgattggtttccatacagtgaagtattttccttatattaaaattaatacttatttttgttatttaagactaatcacgaatcccttgcacacctaagttcataaatgttaaagagtattattttgttttaatttggttccttttaaatagtagtaggaaaaaagaagagatgttatgagtattggataaatcattcttcaacttcatatgaattatgagacccttggcttgttaacttggcaattaaagtctcaccaaattttattttctgtttttctgaaactgtcatatgcatgcaaagaaagaaaagaataaaaaagaatacaccgtggtgacttacataagtcacttagaaaatgtatttggaaatggacgtatttacagtgtgacacagcatgtatctaataaatttcgttatatttctattacacttacatgtgatgttgccttttgctgttttgttggtttgcttgttttctcattatgtgaagattgctttctagtgtatgagataaacgaattttgtctcatctattttcaaatattgtggaaaaaaaaagctaatacataatagaagtagaaaaatatttacatagtgtggattttttttcaccaaatggtagttgtaaaattttgtttttgacctatgttatctatattttaagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347343 - DNA, 1647 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagccagcagagaaagataatggaaatattgaacttgaaaataaaaaattagaaaaagagagtaaatattgaacttgaaaataaaaaattag

SEQ ID NO: 347344 - DNA, 1525 bp, Homo sapiens
ttcaaacaattggttagttctaaaactaagactcggtggacacggcggctcatgcctataatcccagcactttgggaggcccaggtgggaggatcacttgagcctcagtgagctatgagcttgaggctgcagtgggctatgatggtactactgccctccagcctgggcgacagagtagggccctttatctaaaaacaaaaacaaaaaacttcttaaatctctcctgatgggacgaagatgcgatcagcaaaggctccgaggtgccagaggcatagtgagttctccgatccctggctggtggagggaagctgggaagggcctggctgtccagggtggtgggaggaggctagagtagccagaccagatattttgggttgtctctgatgggagaagactggcgcatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347345 - DNA, 1125 bp, Homo sapiens
tagatgagcatttgcaaatgatttgatgtgatggaatatactaaactttcaacctcattaaccaaaatattgtgtctctccacagtaattcaattttgctctgattgtaatcattctcagttattactgtattttgatttcatcagtaagaatttatggacattttaatctcataaatacctataaaatatctttgattttgcctcttactccacaaattctacaatatttgttatctagtacttcatagaaaaagtttactgatccttgctttagatgtttggaatgattttatagcaaatctgaatgctttaggggtctaaaatgattttctccctgttaaaaatttcttcttttctttaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347346 - DNA, 164 bp, Homo sapiens
tcccgctctttctttttctttattttttgatgccgtatactttttacccagaaccaacgaagacaacaaaaaattcaaggaaaagttcttcatttaaatgatatttgtactattgaccatcctgaagacagtgaatatgaagctgaaatgtcacttcaaggaga

SEQ ID NO: 347347 - DNA, 419 bp, Homo sapiens
aaggctatcagcagcaagacagccaggagctgcttcgctacttattggatgggatgagagcagaagaacaccaagttagcatgttatgaccattgtattttatgatcttatcttcataagctttctgtctcatttgatatcttacgagttaaaacaatgaaagctagttattaaggccatcatactttaaaattttttcttacaccagctttttcaactagtatgttttcaccattagaatgaatccagagaattagcagtaattctctttctcatgatggcttaagtttagttgatgtttacagcattaatgttctttaaagattctgttgtactaacctatacgaagagagctgccaaatattggaaattgtttctcccaaacccaggtgcagcacacccttacttttaattctgag

SEQ ID NO: 347348 - DNA, 488 bp, Homo sapiens
caaaaccaaaaagtaatcaacttgaatctttccatttatgtttgatttttcattttctcatgacagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaa

SEQ ID NO: 347349 - DNA, 357 bp, Homo sapiens
ttaggtgaaaggaagcatgtttacaccaatgccaaaaagcagatgctaatttctcttgctcctcctgttcttactcttcatttaaagagatttcagcaggtactccttgttacccaaaatttgttttaaatatgtaacacctactttattacctatttttttcattactgtctcaacatactactttgtttctttggttttctgttgtttcttaactgtaatgtcaatgaagtcagaaagggaaaaacataggggctaggcagaggcgcatgtgaagatggaggcacaatctcctcagatttcctagaactcatttatgtccctctttttagtacgattggcatcttacttttattt

SEQ ID NO: 347350 - DNA, 2975 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347351 - DNA, 343 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttaggaaacctgtgtgcagacacacttacgaacacgggacttggacaccaaggtacatcttgacacagcacacggctttagtga

SEQ ID NO: 347352 - DNA, 3038 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggaacttgtttgcttcattcttatgtacctacctttgcaccttgtaatcatcctttatgcctcagattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaa

SEQ ID NO: 347353 - DNA, 3169 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtggattgttattttgtgtcagtaagtaatccataaagtgccaacatgggaaagaaacggacaaagggaaaaactgttccaatcgatgattcctctgaaactttagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcagggctgtggcagaaattctcaggagcagcatgccttgaagcactatctgacgccaagatctgaacctcactgtctggttcttagtttggacaactggagtgtatggtgttacgtatgtgataatgaggtccagtattgtagttcaaaccagttgggtcaagtggttgattatgtcagaaaacaagccagcattacaactccaaagccagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcagaacttgtcacaaacaccagtgcttagagaactactaaaagaagtgaaaatgtctggaacaattgtaaaaattgaaccacctgatttggcattaacagaaccattagaaataaaccttgagcctccaggccctcttactttagccatgagccagtttcttaatgagatgcaagagaccaaaaagggggttgtgacaccgaaagaactcttttctcaggtctgtaaaaaagcagtgcggtttaaaggctatcagcagcaagacagccaggagctgcttcgctacttattggatgggatgagagcagaagaacaccaaagagtgagtaaaggaatacttaaagcatttggtaattctactgaaaagttggatgaagaactaaaaaataaagttaaagattatgagaagaaaaaatcaatgccaagttttgttgaccgcatctttggtggtgaactaactagtatgatcatgtgtgatcaatgcagaactgtctccttggttcatgaatctttccttgatttgtccctcccagttttagatgatcagagtggtaagaaaagtgtaaatgataaaaatctgaaaaagacagtggaggatgaagatcaagatagtgaggaagaaaaagataacgacagttacataaaagagagaagtgatattccttctggaacaagtaagcacttacagaaaaaagcaaagaaacaagccaaaaagcaagccaagaaccaacgaagacaacaaaaaattcaaggaaaagttcttcatttaaatgatatttgtactattgaccatcctgaagacagtgaatatgaagctgaaatgtcacttcaaggagaagtaaatattaaatccaaccatatttcacaagagggtgttatgcataaagaatattgtgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgtaaatgaagatccagaaactgctttctgtactcttgcaaacagggaagttttcaatactgatgagtgttcaatccaacattgtttatatcagttcacccgtaatgagaaacttcgagatgcgaataaactgctttgtgaagtatgcacacggagacagtgtaatggaccaaaggcaaatataaaaggtgaaaggaagcatgtttacaccaatgccaaaaagcagatgctaatttctcttgctcctcctgttcttactcttcatttaaagagatttcagcaggctggttttaacctacgcaaagttaacaaacacataaagtttccggaaatcttagatttggctcctttttgcacccttaaatgtaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaaaaaaaaaaaaaaaaaaaaaacacaaaacaacaaaaaaaaaaacaaacccaaaaaaaaaaacaaaacacaacaaaaaaaagttttggggggcgcgcgcccccaaaaaaatttttcaaaccccctttgttgtggggggccggcccaatttttattacacctgtgtcaaatggttcccaaaaaacccgggcacacag

SEQ ID NO: 347354 - DNA, 816 bp, Homo sapiens
tagccacttcccataatgccgcgttccggaagttattgctttccaggggtcactctggcttcgactccgtcgctctcaattcgtcaccaggaggaagacggagctggctgcccagcccaaaggcccatgaggggatgcagttatgggctctgtcgccgtgggtgagttctggtcccactgcctggcagtcgtcgctcgcctggctttctgcgctgggagagctcctgttttccgccccaacttcgttctcttcttgaaggccgctctccttaagcacgtaacccggctactttccggtactgcgatctcattggctgcatgttctgtcagttccagaagctggccaatgagatgccgctgctggcggccttctcgaccccgtggacccagaggttcccccgtgggatcggagcagttagaaggggaggagagggaaggtgtggcaggcgccgagcaaatgggtgggtggcgcgtggcagggacttccctatgggttggagctggatttgcagccgtgttcatacggctggtaggaaaagcaggatctgtcacttatccaattgactatatctaggaggggattgatatacgcaaaacttgaaagccacgttaacacctgctgacaaagttttccacacgcttacatttttaatggaaccgagtaggcaggggaagactgggagggcagagagtgaagagacttggaataatatgagaaccggcaagactatctttgatttagattttgtatggagtcctgcgaagagtcatttcactaagacgttaatgctcatccgatgacactacttgaaaagt

SEQ ID NO: 347355 - DNA, 703 bp, Homo sapiens
ctcacacgatcacttaagtttaggagttcaagaccagtctgagaaacatagcaagacctcgctcctatctactaaataaataaataataaacattagccaggcatggtggcacatgcttgtagttcagctactcaggaggctgaagccggaggatcacttgagcccaggaggttgaggctgcagtgagccatgactgtgccactgcactctagcctaggcatgagcaagaccctgtctcaatcaatcaatcaatcaataaagcattttgtatttgtctctctgctctccctatgctgactagaagcatgacactctccctcttggtacagcactgaggccgtcagtcaccagaatctggtgactcctctatcctcagctcctctgttactcgtctgatctacagtcctttaatccatcatctctgtctggcgcgggttgtttcccaagcctcccagttgcttggccagctttggcactcctacccctatcctctttctcaactagcagccagagttttcctattaaaagctaagccaggtcaagtcactcttggcgctggagtggcttcccatctcgttcagagtgaaagctggtgttcacagtagcctacaaggccctgagtgctctgacctgtcttcttctctgatcctctggagtctttctcctgacagcttgctgggtgggtgggggttgcttccctcc

SEQ ID NO: 347356 - DNA, 272 bp, Homo sapiens
ttgagccactgggcacaaggcagttgggtattccttttgattagcttttgttagctcaggaggaagcctttcatcacttccccctttgggggctcagcttcctcaccaggcattctgggccttcactctctccctctgtactcccttctttgacaaaggtttccttttcctgttcccttagctttgtcctttttgcactttctgtaatcccaccagcagcagtgttcccttttgtttggaaataaggacgagaaagaaagggaggtggagaa

SEQ ID NO: 347357 - DNA, 1290 bp, Homo sapiens
ggcatggcagcagcatctggtggggttctgtgctacattaccccatggtggaagggcagagggcagagggcagaagaggaaaggcagaagagaaagacagcatgggagacagcaagaaaatggaggccaaaacttatccttttatcaggaatccactcccacacatgtttgtaaacaatgccatcaggaataaaagtgtttgaagctgaagctgggtcttccatccaaatgtggaaagcgtgccagaggactgtctttcccattcccgccccacctgcacagccatagacaaagctcagctccgggataagaggaaaaagcactgcctggacctgtccaccagcaagcggacattgctttgcataaacaggcagaggggcaggcacctcaagggactcgcagaagtgcctgggtatttttaaatacttgaggagaacacaaggatgcctgtcggacatctcaggaactgctagctccagcaaaattcactgcaggataggccaggtgatgctgtggtgacaaacaacttcccaaattgctgcaattcacatacaaagtttcctgctcactcacgtaatatgccgtccaagatctgcagggattctgcttcaagctgtctgcattcttactctgggactctgagatgtgggttgatggaacagctaccatctgaaacattgtcagtgatgatgacacaggaaagagtgtgaagcaaaggttctcctggccctcaaagccttcacctataagtgatactctttcctgcttgcatttcgttacccatatgagatatatgaataagccaaattgcaaagaggtcttgggtgttggagaacaatagcacagccagcccagcacacacaccctgttacacattgtattctgtgcttcacactggagctagagccagacttggtcttacctccacaggtctacagtctagtgaaaatacaaacaagagacccctctgtgctgagattccctgcctgcctggtgggtgggcagagccagcagaaggatgtcactatgacaagtagcccagcccaggaaacctctttgtccccactggcctgagattcccatcctactccaagagacactccatagcccaacctgggagaacctgttccgtccctcaaacagcaccagcagggagtgggattcccagccctcatagataaacaaagaccaaagtctctgaaatataactgatttaaaaccacagcccacaaaagtaatccaggacctgagtgcttaacctaaacagagtgactgccagctaaaataaaa

SEQ ID NO: 347358 - DNA, 430 bp, Homo sapiens
agaatgctggtccctgtggctcagcacaacaggtgtctgcctcacaggaaatccttgccttttaggcatctttcaacatatgccattgttaaaatcctgtttcttcaagttttacaattcgtatgttgtaatttgaacagctcagcttccatgctcattagatcatatattatgtgtattttatacattcattccttaggacttacttctattatatataatttatatattacataatatataacatgtaatacatgaataatagtagatcttgtgtcttcagggaaaagagtatcttcttttactcaaaggctgggagaatgttacatccattatcacatagtttaccattctcaaaagaatggggcttctgtatttaaaaatatctttacattttattttattcttttttagagatagagtgtcactc

SEQ ID NO: 347359 - DNA, 909 bp, Homo sapiens
cacttaatcctcacaatactataaggtagacattattatcttcattttcaaaaagtgaaactgaggtaaaatatcccatgactagtaagtgatgaagttaggatttcaatccaggcagtctgattccagagcccatcttcttactcacaaatgaagattgttatacatttatgtatttttttccatgaatattttctgatcatgtactcatggtgcctagtataggagctggggatagagtaggcagcaatcagaatctctgctaccatggagcttatatttctagtcaggggaaataggaaataaataagtatttatatgaagtggtaataagtgctgtggagagaagtaatgcaagtaaagaggataaggatgttggggagagagttgctattttctgttgggcagttagggaagaactcactaataaggtgacatttgagcagagaattgagagagtaagccttgagagcatcttgaagaagtgttcactcttctactgttcaactagttgtgtaaaccactagtggtcctctagtatccattgtctcctttctttatgtaaagaacctctaaattttctgttggcatatgaccactgaaaatgaagattagattttgtagctttccttacagctaggcttggtcatgtgattgatgtgtgcagttgccaggctgtgcccttaaaagaaagggtatgccttctcctttccttttccctccatctcactagttgggatgggacgtggcacacatggtggtaaattattttggaccttaaagatgaggactacttccttggagaaggcagaacaactgaaggctaccgtggtagcctcagagtacttatatttggatggttatgtgagagaaaaaaataaactatcatgtttaagccatgatattttg

SEQ ID NO: 347360 - DNA, 82 bp, Homo sapiens
ttttgttgtttgtttgttcttaacaacatggcctaaagttgtttggtaagttcattctggatctagagattgattcaccagt

SEQ ID NO: 347361 - DNA, 270 bp, Homo sapiens
ataatatgggcaaaacctcagctgaatacttgatgagctgaccgtattattaacaaagtactgccagatgttaagttttaagacctatatgtgggtaacctctgaaagttgtctgcaccacagccttgaacttttctactgaatgtaaagagtaaagtccatcatgaagacaggaaaatggaaatcaaagctccctcctgatacttggcacccaaaggctccacaaatctgtcaatccaagtaacttttactttgcaagcaacagggtgt

SEQ ID NO: 347362 - DNA, 380 bp, Homo sapiens
aagctcaagtgcagtgttgtggtcatagctcactgtaacctcaaactccttggctcaagcagtcttccctgtttagcctcctgagtagctgggactacaggcatgtaccaccacacctggctaactttttaatttttctgtaaagatgagatcttgccatgttgcctaggctgatcttgaattcctggccccaagtgatgctcctgtctcagcttcccaaagggattacaggcttgagccatcacacctggcttctcttgatattttttgaacttgtgatattttgtgaatatatatgcctttgcaaacatgcatgtctatttttctgttaaaatatgttattttacaaaaaacattataaccaaattattggaaatgca

SEQ ID NO: 347363 - DNA, 273 bp, Homo sapiens
tgcttaatgttatatttttatttttcagtattttcataaagttgctggccagcttttacctcttgcatataatctgttgaagaggaatctgtttgcagaaattatgaaggatcatctggcaaacagaagaaaagagaacatagaccaatttgctgcatgagtaaggtggtttgtttggtgtataatatttcaaaggactagtattaaacttgtaatttttgttttgtttttaaggaatacaaaaaaataaacatttactaaaaacgttaaaaa

SEQ ID NO: 347364 - DNA, 937 bp, Homo sapiens
attcggctggcgctgcagctgcagaatggtgggcggtggctggaagcgcaggcccggcgcgggggcggggccgcagatactgccagaaaggctgtgggggctacgcaggtggctttggatgacagccagggtaccaggaggcagcgcgtttcattcatgcagtgactattaagcttgctgtgtgtccggggtctgcggtttgctgcggggaccctgcccaggtcgctgtttcgcgctctgtaggggattggaccagtgtgaaaaaacagttgatgtgaagaaaagtaaattctgtgaagctgatgtctccagtgaccttcgaaaagaagtagaaaatcattatacgctctctttacctgaagatttctatcacttctggaagttctgtgaagaacttgattctgaaaaaccagctgggattctcctgatgaacttcctgtatatgttggtataaatgaagcaaagaaaaattgtataattgttccaaatggagataatgtatttgctgcagtcaactgacctcaagagaatttgcaagacaatagttgaggctgcaagtgatgatgagagacgaaaagcttttgctcccattcaggaaatgatgacttttgtgcagtttgctaatgatgaatgtgattatggtatggggcttgagttgggaatggacctcttttgctatggctcacattattttcataaagttgctggccagcttttacctcttgcatataatctgttgaagaggaatctgtttgcagaaattatgaaggatcatctggcaaacagaagaaaagagaacatagaccaatttgctgcatgagtaaggtggtttgtttggtgtataatatttcaaaggactagtattaaacttgtaatttttgttttgtttttaaggaatacaaaaaaataaacatttactaaaaacgttaaaaaggtt

SEQ ID NO: 347365 - DNA, 1285 bp, Homo sapiens
attcggctggcgctgcagctgcagaatggtgggcggtggctggaagcgcaggcccggcgcgggggcggggccgcagatactgccagaaaggctgtgggggctacgcaggtggctttggatgacagccagggtaccaggaggcagcgcgtttcattcatgcagtgactattaagcttgctgtgtgtccggggtctgcggtttgctgcggggaccctgcccaggtcgctgtttcgcgctctgtaggggattggaccagtgtgaaaaaacagttgatgtgaagaaaagtaaattctgtgaagctgatgtctccagtgaccttcgaaaagaagtagaaaatcattatacgctctctttacctgaagatttctatcacttctggaagttctgtgaagaacttgattctgaaaaaccagctgagatccactttctgcaagccttggacttcaattagttgatccttataatatccttgctggaaaacataaaatgaagaaaaaatcaacagtcccgaattttaaccttcattggaggttttactatgatcctcctgagttccagaccattattattagagataaactcagtgccacatggggtatttcagggattctcctgatgaacttcctgtatatgttggtataaatgaagcaaagaaaaattgtataattgttccaaatggagataatgtatttgctgcagtcaactcctcctccctgccccagctgtttcttttttcatgtggatactggaaaaaatgtagcctgtattatattacacttggacaggctgatctgtcctatatctcctctttgaagccagaggcaattagtctctgatgggaccagtgtgggctctagctactgctgacctcaagagaatttgcaagacaatagttgaggctgcaagtgatgatgagagacgaaaagcttttgctcccattcaggaaatgatgacttttgtgcagtttgctaatgatgaatgtgattatggtatggggcttgagttgggaatggacctcttttgctatggctcacattattttcataaagttgctggccagcttttacctcttgcatataatctgttgaagaggaatctgtttgcagaaattatgaaggatcatctggcaaacagaagaaaagagaacatagaccaatttgctgcatgagtaaggtggtttgtttggtgtataatatttcaaaggactagtattaaacttgtaatttttgttttgtttttaaggaatacaaaaaaataaacatttactaaaaacgttaaaaaggtt

SEQ ID NO: 347366 - DNA, 928 bp, Homo sapiens
tgcagtcatggaataaggccataccctgtgggtagggtataaaggtttccctctatatagtaggtgttcttattatcagtcattcaaagaaaaagagaatcctcaccagaaaatcttggaacatagaacagatggaaggtggcacttctggatatgcctttttacatctgaacttggaagagttaagaattgttgaaggcccttctcactgatcaggggaaatagcttctgtcacagagctgcctactccaggagaaccaaaaatgaaagtaaacactcatattttgtaagtctgttcctcaacttccatcaatcaagtttaatctaaatcaaggattcaaactgagaagcatttaaggaccaagaaaaagttaattagcccagtataagtcaacaagaaatggtaagcagtatggaggaaaagaagtgccacacccttctaggcatccaaattcaagcatttacaatgtacttcatgaagcagtaccctatacagcactaataacagcccaaacttgcttgacatttctacataacacattattcattaattcagaagaaaaatagaattcttaaaactcctaactttatttttaattaatataaaggaggaaccaacaacaacaaaaaattgtgtgggagttagaaaataaggactaggcgcctgggcgcggtggctcacgcctgtaatcccagcactttgggaggccgcggtgggcagaacacgaggtcaggagattgaggccatcctggctaacacggtgaaaccccgtctttactaaaaaatagaaaaaattagctgggcgtggtggcgggcgcctgtagtcgcagctactctggaggcttgaggcaggagaatggcgtgaacctgggaggcggagcttgcagtgagccaagatcgcgccactacactccagcctgggcgaca

SEQ ID NO: 347367 - DNA, 2897 bp, Homo sapiens
tgggcgtcgtaggggagaggaggggcggggccgctccgctgcaacagcaaagttttgagcaaagccttagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaa

SEQ ID NO: 347368 - DNA, 1191 bp, Homo sapiens
taacaatcttactgtaatgactattatcattaggatcataattacctttggactatgtagaaatattaatccgttagagtttgcactgagctttaagtgacatgcatattgtagtttagcaatgaagatatcataaatgattatgtactagcaattagaagtctttctcaaatttacttataaactgttatttcatttctcccttccaatgcttattgcttgcctctctttttcagcatcctactttatatactcttcctctccatgatacatgtttttaatttctgcatactagttgttcctcttctgagttcttattcagtttatctctcactctcccttgccccaagatatcaaaaggcctttgaaacttatcagacctgaattctgtgaaacctttatgagaagccctgcctggctctaaaattcctgtggaagttccagtaacttctaatccctcgttctgtcctttcttcttggttacgtagcattcacatatattgtctgcacagtactgggatgtatgttctgttttatttttcaaatatgttttaaattgtagacctgtagtgttttgtacataatgactgtaaattttgtccaaattttttggaaagtatttttttaaagcaaaaagattttataaatgcaatatattttgctttaagcatctcagtgggagaaacctgaaggatttcaaggagacttaaaaaaggtaattgaagcatattaatagtgtttttgttttattctttacagtgattcgtttcttaggtttttgtagagttttgctaagcaactttatttacaaatactccactccctccacccccaaactgtgtccttttttttcccataatgcttttgttagaaggctggatggagatgaaatagtgatatctggctgggtgcagtggctcatgcctgtaatcccagcactttgggaggctgaggcatgtggatcacaaggtcaggagttaaagaccagcctggccaagatggtgaaaccctatctctcctaaaaactacaaaaaaattagccaggcgcagtcgcagttgcctgtaatcccagctactcaggaggctgagtcaggggaatcactgggacctggggcggcagaggttaacagtgagccgagattgcaccaccgcactccagcctggataacaaagtaagactccgtctcaaaa

SEQ ID NO: 347369 - DNA, 2252 bp, Homo sapiens
ggggtagaaatgttaccccgctgaacgccctgggggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaa

SEQ ID NO: 347370 - DNA, 2449 bp, Homo sapiens
taacaatcttactgtaatgactattatcattaggatcataattacctttggactatgtagaaatattaatccgttagagtttgcactgagctttaagtgacatgcatattgtagtttagcaatgaagatatcataaatgattatgtactagcaattagaagtctttctcaaatttacttataaactgttatttcatttctcccttccaatgcttattgcttgcctctctttttcagcatcctactttatatactcttcctctccatgatacatgtttttaatttctgcatactagttgttcctcttctgagttcttattcagtttatctctcactctcccttgccccaagatatcaaaaggcctttgaaacttatcagacctgaattctgtgaaacctttatgagaagccctgcctggctctaaaattcctgtggaagttccagtaacttctaatccctcgttctgtcctttcttcttggttacgtagcattcacatatattgtctgcacagtactgggatgtatgttctgttttatttttcaaatatgttttaaattgtagacctgtagtgttttgtacataatgactgtaaattttgtccaaattttttggaaagtatttttttaaagcaaaaagattttataaatgcaatatattttgctttaagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaa

SEQ ID NO: 347371 - DNA, 1777 bp, Homo sapiens
atagtatgaaatacatacagtattgtcatttaataattgtaagtgataaatgttatgttgaaattacatctgaatagaattaataactaaataacatgactttaaaatgtgttgagcagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaa

SEQ ID NO: 347372 - DNA, 1639 bp, Homo sapiens
tgggcgtcgtaggggagaggaggggcggggccgctccgctgcaacagcaaagttttgagcaaagccttagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaaggtaattgaagcatattaatagtgtttttgttttattctttacagtgattcgtttcttaggtttttgtagagttttgctaagcaactttatttacaaatactccactccctccacccccaaactgtgtccttttttttcccataatgcttttgttagaaggctggatggagatgaaatagtgatatctggctgggtgcagtggctcatgcctgtaatcccagcactttgggaggctgaggcatgtggatcacaaggtcaggagttaaagaccagcctggccaagatggtgaaaccctatctctcctaaaaactacaaaaaaattagccaggcgcagtcgcagttgcctgtaatcccagctactcaggaggctgagtcaggggaatcactgggacctggggcggcagaggttaacagtgagccgagattgcaccaccgcactccagcctggataacaaagtaagactccgtctcaaaa

SEQ ID NO: 347373 - DNA, 410 bp, Homo sapiens
gccaaagaaattctgtgattactgcaagtgctggatagcagacaataggcctgtatgataattccgctgttagagattctaataataattgtgttgaatgaagtgctcctttttgatgtaaactcagtttacaaagcacttttatgtacattgctcttgcattttcaaaacatcagaagatttctgtcttctcagtcccctatgaaagctgtgagccttcttccttttcatcaacctgactttgattatatattaaattatttctctgtggccttttgggaaatgggcaatgagttggtcatatcattcatgttatgaagcacctatattataatggtggtgttcataatactgtcatacccaaagaattgtggaaagcccttaaaaaataaaagcaacatgtttagttt

SEQ ID NO: 347374 - DNA, 287 bp, Homo sapiens
ctgctttacccttctctcatctctttagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggaggtaagtcatttaggcataaaactggtaaagaacagtgtcactagtagaatagaacaatttattttatgttaggatttttatc

SEQ ID NO: 347375 - DNA, 1271 bp, Homo sapiens
tgggcgtcgtaggggagaggaggggcggggccgctccgctgcaacagcaaagttttgagcaaagccttagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtggcagaaacctgaaggttttcacggagacttcacgacagcactgaagaccggttggctgaaggtttaagctcacgacgcttttacctatcctattcctctgctccggtgcaatccactgcacgcccgagcactcattcccacctct

SEQ ID NO: 347376 - DNA, 1963 bp, Homo sapiens
tgggcgtcgtaggggagaggaggggcggggccgctccgctgcaacagcaaagttttgagcaaagccttagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtga

SEQ ID NO: 347377 - DNA, 1173 bp, Homo sapiens
tgggcgtcgtaggggagaggaggggcggggccgctccgctgcaacagcaaagttttgagcaaagccttagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggagcagatgcgcccatcagggaaatgcctcttattcctggttccccctcactgcctttttcacccttgtactgatctgggtggaagtgactcctgatggacgaaggcggtcc

SEQ ID NO: 347378 - DNA, 432 bp, Homo sapiens
ttttcttttgaattatgtaagtaatgtgggcaatcattgtgaagtcttattgagggtcttttagcaagacagtgacatgatgacttgtcttagaaaggtaattttggcagctgtggtgaagatttgaaaggagacactggagctggaagagcaatttcagagtctctgagaggccaggtgtaatggttcacacttgtaatcccagcactttgggaggtcaaggtgggaggattgcttgtggctgggagcttaaggctaccctgagcaacagggcaagaccctgtctctaccaaaaaaaaaaaaaatttctgggcatgatggcatgcctgtggtcccagctatttgggaagctgagtgggaggatcttgagctgaagagttcatgttgcagtgagttatgattatgccactgtagtccagcctgactgtctca

SEQ ID NO: 347379 - DNA, 431 bp, Homo sapiens
tgatggtgcccggctggcagagctgtgatgaggattagaggtgcaagcagctcagctcatggaaaagactcagggctgatgggtggagacacatccatggaccccgcagaccctgccaggagcttgcacagaccccaccaggagccttgggggcaggttggagtggcccaggtgcttggacagctctgggttggcagctcacttggaggtggaagtgctggaggaggggaggccccagatgtgccccaaccccaccccaggccccgtccccagcgaggaggagagtgaagggccgtcggccctccctgagcgggcacctcccactcctgcgggcctggtggtgaattatagagaaaatgtgctctcggcctgactgttagctttgagctgctctggttgggaattgagtttcttaataaacaggaaaatga

SEQ ID NO: 347380 - DNA, 680 bp, Homo sapiens
tttcattttacagatgagaaagttgaggcttagtgagattaaatctcgggtctctcatgaagagctgtcttcctcttgctattccagacagaacaaagggaaaagggcttttcttaggcacaggcttgtaactgcccctgccccccacccaccaaagctgagaagaggcaattccagcagcaaggcttattaatggctctctcaacacattcccagactccactcagccagacagaaaaaggtgcagggtgatgatgcagtgccacgcaagtctcggtgggactccggcatccagtatcctcaggaatcatgccttgcctggaccttttggctgttgtgaataatgctgctatgaacatggctgtataagtaaccatttcatttcctgccttcagttcttttgagtgtacaattgtcccttggtgtccttgggggactggtttgaggtccttcctcccacagatatgaaaatctgtgaatgcccaagtccctgatataaaaatggcatagtatttgcacataacctatgcacgctctcccatatactttcaatcatttctggattacttgtaatacctaatacaatgtaaatactatgtaaatagttatactctattgtttagggaataataacaaggaaaaaaagcctatacatcttcagtacaggcagtttttttttt

SEQ ID NO: 347381 - DNA, 656 bp, Homo sapiens
tttcattttacagatgagaaagttgaggcttagtgagattaaatctcgggtctctcatgaagagctgtcttcctcttgctattccagacagaacaaagggaaaagggcttttcttaggcacaggcttgtaactgcccctgccccccacccaccaaagctgagaagaggcaattccagcagcaaggcttattaatggctctctcaacacattcccagactccactcagccagacagaaaaaggtgcagggtgatgatgcagtgccacgcaagtctcggtgggactccggcatccagtatcctcaggaatcatgccttgcctgggattggattgtggataggaaaactttgtttaaaatatgctggagagggctgggcacagtgggtcacacctgtaatcccagcactttgggaggccaagatgggcagatcacttgaggtcaggagttcaagaccagcctggccaacatggtgaaactccatctctactaaaaatattaaaaaattagctgggcatggtggtgtacacctgtaatcccagctactccagaaggtgaggtaggagaatcgcttgaatccaggaggcagaggttccagtgagccaagattgtgccattgcactccagcctgggtgacagagtgagactcggtctcaaaa

SEQ ID NO: 347382 - DNA, 2870 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347383 - DNA, 2656 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactggagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347384 - DNA, 2453 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347385 - DNA, 2667 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347386 - DNA, 2085 bp, Homo sapiens
ggagaggatagagagagagatacccgacagagagacgacagagtacatcaatgatacgtgaccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347387 - DNA, 1677 bp, Homo sapiens
  misc_feature (11)..(11): n is a, c, g, or t
ctagtcatagntacgaggctgggtgggagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347388 - DNA, 1909 bp, Homo sapiens
gccggctaccatatggttggacgaggacattacattaagatacggaccaaagtgctgggattacaggcatgaaccaccatgcctggactattgccattttcagtgttgtgtccagtgatgtttccttcacaccaagaagtcttcaggggattcatatatggattgtgaaatcctctagtgacatggaagtttctgtgtcatgcagatagagaaattgtgatgcctggatgcctgaggttttttggagtgaggtactatgcatttgcaagtaattgtaaactgtataatccaggattaaaagataaactattgttgcatttagaactgtgtttagaatacaataatttgttgttgttttgtaataggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347389 - DNA, 1927 bp, Homo sapiens
ttcactgtgttggccaggctagtctcaaactcctgacctcaggtgatctacccgcgtaagcctcccaaagtgctgggattacaggcatgaaccaccatgcctggactattgccattttcagtgttgtgtccagtgatgtttccttcacaccaagaagtcttcaggggattcatatatggattgtgaaatcctctagtgacatggaagtttctgtgtcatgcagatagagaaattgtgatgcctggatgcctgaggttttttggagtgaggtactatgcatttgcaagtaattgtaaactgtataatccaggattaaaagataaactattgttgcatttagaactgtgtttagaatacaataatttgttgttgttttgtaataggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347390 - DNA, 2488 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347391 - DNA, 1318 bp, Homo sapiens
gaccaaggatgactttgggcattgctgtgaggaactatttcgtttaacaccctactacctgaacatgatgcgtactcagcctttcaccaccccccaagtagctacacatgatgtgataatagtattggtggtggttttagagagttggagagaaaactgaagttggatttgggtaaaagaaaaaagagtgggaattattttttctccattctaaagcccataaagcaatgttaattgttcccacccctctgctattctgtctcctcaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347392 - DNA, 4315 bp, Homo sapiens
  misc_feature (1095)..(1095): n is a, c, g, or t
  misc_feature (1164)..(1164): n is a, c, g, or t
  misc_feature (1742)..(1742): n is a, c, g, or t
  misc_feature (1774)..(1774): n is a, c, g, or t
  misc_feature (2160)..(2160): n is a, c, g, or t
  misc_feature (2265)..(2265): n is a, c, g, or t
  misc_feature (2281)..(2281): n is a, c, g, or t
  misc_feature (2762)..(2762): n is a, c, g, or t
gttgattgtagagaatgcagacctcgtgtcatgctcaagtgtcaccttaatgtaatggctggagacagccacatatgaccctctcattgtccagtcagtaagctcaatcaatgacaggaaccactgactctggtaattaaaaacttattgtggccgggcacagtggctcacgcctgaaatcccagcactttgggaggcaaaggtgggcagatcacctgaggtcaggagttcaagaccagcctggccaacatggtgaaaccccatctctactaaaaatacaaaattagctgggcgtggtggggttgcctataattccagctactcaggaggctaagacaggagaaacacttgaacccaggaggtggaggttgcagtaagctgagatcgcatcattgcactccagcctgggcaacaagagtgaaactgtctaaaaaacaaacaacaacaacaacaacaaaaacacttattgctgggcaggttctcataagaggccatgggaaagccatgtcctatctcagggacacagggtcatctgggcctctggctaatagaggccaaataatgggactattttccctgtgaaatcctgaaaaccaaaaatggtggcgtctttatctgcattagcagaggtaatttgctccttcttgaaatccaaggtcacgtctactgtctggggattttgatccagggtcagtgtggtttctcctttacaggagagccgagtctcagaaaggtgaggtggtttgtgttggtcattggctacctcagattttagagcagctctaccttgattgtggggttgacctaattttttttgctgtcttctttcttctccaggtgaggaaagaggacttcctgtatatctctatccttttgtttccattactcactttctgtggctgctgctgcagaagccactgctgactgatgtggatacctcaatctttggtttacaaaaagcctaggtgtcttttggcctctctccaggttgatagccatggctcctgaaagaaataaaagatgatcatctttctaaaaagtcttaagtctgaattattagtaacttaactggagaatctcacttttcctactctngtattttaaccacagttgctctaacacagacctttgaggatcttttcatgacttcattcacaaataccnatttatgctgtacagatgctactaggaaggaaatagggatgtctgttttgactgtggaacttaacttggtctcgtctcttcgtgcatgcaaccctgtccttgggatagctttcttgagcatatctacttatgttcaagaggtaaattgtcctgaaacccccattgctataagtatttattttattactcataatacttaatgctcctaaagttggggtattttttttttggatacctaaacttcattgagatactttgaactatttatagagaaaacggaaccttctaatacctggcttctatttcttaaaatgttatgatcatacatggcttagggctttatggccaaataacttcactgaacccaggaaaaagaatagatccatctgaaacagacctgtagcttccagaggcctaaattttcggctccatttgtatccttcattttctgtgaggtaaagaagtggaaggagacaagcctcagcccttcccctggcacctttactcttcgcccttcctcctggcatggtggaaagtgcactggaggaggagtgaagggccctaggtttgcatccatnttctgccacttgccaaccttaatggcccttanaattgatttaccctcatgaaatttggaatgatttctaaagtctttcctcgccctgaatgttaacattttttgatagtcaggactttctgtagcttcaccttccttatttagtgttatttttttctcaagactgaacagagagggaagctgtcaaagtgtgctgggcacacaccctgcagtggggcaatggccaattctaatctcaagtcattaggctgcagtagcatgaccactgcttcctgtctaccctcagagggtagagacagctgagctcctgtagttggggtcaggcccagccactctgtggggacagtgattagtgttgtgtcaccaattcagggaaggagccaccttgtcttattttccctcttgaattatcttgatangaccccattataaatttccttttgtaaacctctgtctcccaatttctccttttagcttactttctattgaagtagaggaacagagtacaacttccatcctctttnatcagccctgagagcngaacgcaagcgccgttactgggaactatatccttggctccctggatgtggctattaacttctggcctgccactctatcacatacacatatggagatggtgtcatccatgtaccttaccccgtatttacaacttctatcacccaacagtgccaatggccctgatggtccctctgggagggagagaagagtaagctggagtcaccccttccctgtacttcccacctcgccaggcctgttggtgttagtgtcccttctgatcttggcctgacccctgtgccctgggcactgggctgcaggttggagaggcagcatgatggagtggggataacacatactccaaaaccaaacagaagccagacctgggttgggtcctggcgaaacagtctagaggcttggtgaccttaacctcctaattaatcttcctaagcataagtttccttatcataagttatgtatgataaaattttccttggatgcattnattttagcatgacttgaaattatgtgtgaaggaacctggcccacggaagttgccctgtaaattcagattcactttcccttggacatatggatgacattagctcattacagttatgacctccctaaaactcccaaatattctttaagttcttctcttattttccctttagtttgtagtcatatttcttagttcttatatcagttgggattcccacatcttctagttggacaatattggagaagacaccacattttaactgagttccagtgatatgacaggctttcaattctctaatctcacagaagttagaaaaaaagtagataatcaaaatccacagaaaatatagaagattccattaactctgagaatgattctcaggtatccttaggacctcaagaaagctgttctctcctgggcctgtagagagttcaagtgccaggaatctaccacaaagtagccgggaggtgcagggcagcagggggcacagtgaagtgctgaagggcttctcagtcttctttaattagagtgagaagaaaagagcacctcctcattttagagtacatggtgtgaactcactctcagctgccaagtgagcttcaccttgggctgttttgcatgctttctcctagtgctttaagccaccctgagatgtacagaccaatactggccatcacaaaaatatactcgagtacatagaccattgacactataaagcaagtaaacaatgaagtctacataacagccaaataacaacatgatgataggatcaaatctgcacatatcaatattaaccttgaatgtaaatgagctaaatgcctcaattaataggcagagagtggcaagttggacagagaagcaagacccaactgtatgtcttcaagagacccatctcatatgcagggacaccaatagcctcaaagtaagggatggagaaagatctatcaagcaaatggaaaacaaaaaacagcactctctgtccaacaaaaacagaatatacattcttttcagctgcacatggtacatactcttaaaatcgaccacaattgctttattggccagaaagcaattctcaacaaattcaagaaacctgaaataccggccaggtgtagtggctcacacctgtaatcccaacactttggaaggctgaggtgggcaaatcacttgaggtcaagagtttgagaccagcctggccaacatggcaaaaacccatctcttctaaaaaatataaaaattagccgtgcatggtggcatgcgcctgtaatcccagctacttcggaggttgagtcacgagaattgcttgaacctgggaggaggaggttgcagtgagctgagatcacgccattgcactccagtctggttgacagagtgagactcatctcaaaaaaacaaaaaaaccctgaaataccaaccacactcttggaccacagtgccataaaaataaataccaagaagatctctcaaaaccatataattaagtggaaattaatctactcctgaatgacttgggtaaacaaagagaaattaaggcagaaatcaagaaattgtttacaact

SEQ ID NO: 347393 - DNA, 4626 bp, Homo sapiens
  misc_feature (1406)..(1406): n is a, c, g, or t
  misc_feature (1475)..(1475): n is a, c, g, or t
  misc_feature (2053)..(2053): n is a, c, g, or t
  misc_feature (2085)..(2085): n is a, c, g, or t
  misc_feature (2471)..(2471): n is a, c, g, or t
  misc_feature (2576)..(2576): n is a, c, g, or t
  misc_feature (2592)..(2592): n is a, c, g, or t
  misc_feature (3073)..(3073): n is a, c, g, or t
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtgagagccaaggcctgttctttccacttctggggctgtgacttgagtttctccgcaggagcagatagtgtttgtgtagggactgcggacttttgcattacagcctccctgctttgcccgcctgctgctggaagcttagcaggtgaggaaagaggacttcctgtatatctctatccttttgtttccattactcactttctgtggctgctgctgcagaagccactgctgactgatgtggatacctcaatctttggtttacaaaaagcctaggtgtcttttggcctctctccaggttgatagccatggctcctgaaagaaataaaagatgatcatctttctaaaaagtcttaagtctgaattattagtaacttaactggagaatctcacttttcctactctngtattttaaccacagttgctctaacacagacctttgaggatcttttcatgacttcattcacaaataccnatttatgctgtacagatgctactaggaaggaaatagggatgtctgttttgactgtggaacttaacttggtctcgtctcttcgtgcatgcaaccctgtccttgggatagctttcttgagcatatctacttatgttcaagaggtaaattgtcctgaaacccccattgctataagtatttattttattactcataatacttaatgctcctaaagttggggtattttttttttggatacctaaacttcattgagatactttgaactatttatagagaaaacggaaccttctaatacctggcttctatttcttaaaatgttatgatcatacatggcttagggctttatggccaaataacttcactgaacccaggaaaaagaatagatccatctgaaacagacctgtagcttccagaggcctaaattttcggctccatttgtatccttcattttctgtgaggtaaagaagtggaaggagacaagcctcagcccttcccctggcacctttactcttcgcccttcctcctggcatggtggaaagtgcactggaggaggagtgaagggccctaggtttgcatccatnttctgccacttgccaaccttaatggcccttanaattgatttaccctcatgaaatttggaatgatttctaaagtctttcctcgccctgaatgttaacattttttgatagtcaggactttctgtagcttcaccttccttatttagtgttatttttttctcaagactgaacagagagggaagctgtcaaagtgtgctgggcacacaccctgcagtggggcaatggccaattctaatctcaagtcattaggctgcagtagcatgaccactgcttcctgtctaccctcagagggtagagacagctgagctcctgtagttggggtcaggcccagccactctgtggggacagtgattagtgttgtgtcaccaattcagggaaggagccaccttgtcttattttccctcttgaattatcttgatangaccccattataaatttccttttgtaaacctctgtctcccaatttctccttttagcttactttctattgaagtagaggaacagagtacaacttccatcctctttnatcagccctgagagcngaacgcaagcgccgttactgggaactatatccttggctccctggatgtggctattaacttctggcctgccactctatcacatacacatatggagatggtgtcatccatgtaccttaccccgtatttacaacttctatcacccaacagtgccaatggccctgatggtccctctgggagggagagaagagtaagctggagtcaccccttccctgtacttcccacctcgccaggcctgttggtgttagtgtcccttctgatcttggcctgacccctgtgccctgggcactgggctgcaggttggagaggcagcatgatggagtggggataacacatactccaaaaccaaacagaagccagacctgggttgggtcctggcgaaacagtctagaggcttggtgaccttaacctcctaattaatcttcctaagcataagtttccttatcataagttatgtatgataaaattttccttggatgcattnattttagcatgacttgaaattatgtgtgaaggaacctggcccacggaagttgccctgtaaattcagattcactttcccttggacatatggatgacattagctcattacagttatgacctccctaaaactcccaaatattctttaagttcttctcttattttccctttagtttgtagtcatatttcttagttcttatatcagttgggattcccacatcttctagttggacaatattggagaagacaccacattttaactgagttccagtgatatgacaggctttcaattctctaatctcacagaagttagaaaaaaagtagataatcaaaatccacagaaaatatagaagattccattaactctgagaatgattctcaggtatccttaggacctcaagaaagctgttctctcctgggcctgtagagagttcaagtgccaggaatctaccacaaagtagccgggaggtgcagggcagcagggggcacagtgaagtgctgaagggcttctcagtcttctttaattagagtgagaagaaaagagcacctcctcattttagagtacatggtgtgaactcactctcagctgccaagtgagcttcaccttgggctgttttgcatgctttctcctagtgctttaagccaccctgagatgtacagaccaatactggccatcacaaaaatatactcgagtacatagaccattgacactataaagcaagtaaacaatgaagtctacataacagccaaataacaacatgatgataggatcaaatctgcacatatcaatattaaccttgaatgtaaatgagctaaatgcctcaattaataggcagagagtggcaagttggacagagaagcaagacccaactgtatgtcttcaagagacccatctcatatgcagggacaccaatagcctcaaagtaagggatggagaaagatctatcaagcaaatggaaaacaaaaaacagcactctctgtccaacaaaaacagaatatacattcttttcagctgcacatggtacatactcttaaaatcgaccacaattgctttattggccagaaagcaattctcaacaaattcaagaaacctgaaataccggccaggtgtagtggctcacacctgtaatcccaacactttggaaggctgaggtgggcaaatcacttgaggtcaagagtttgagaccagcctggccaacatggcaaaaacccatctcttctaaaaaatataaaaattagccgtgcatggtggcatgcgcctgtaatcccagctacttcggaggttgagtcacgagaattgcttgaacctgggaggaggaggttgcagtgagctgagatcacgccattgcactccagtctggttgacagagtgagactcatctcaaaaaaacaaaaaaaccctgaaataccaaccacactcttggaccacagtgccataaaaataaataccaagaagatctctcaaaaccatataattaagtggaaattaatctactcctgaatgacttgggtaaacaaagagaaattaaggcagaaatcaagaaattgtttacaact

SEQ ID NO: 347394 - DNA, 3324 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtgagagccaaggcctgttctttccacttctggggctgtgacttgagtttctccgcaggagcagatagtgtttgtgtagggactgcggacttttgcattacagcctccctgctttgcccgcctgctgctggaagcttagcagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtgtgctcggaaatctcttccttaactgtgactttctgacaggtggaggatgtggtcaggagtgggaaaaggattcgagacgggaagagggaggggttcaggatgaagagagataatctgtgccacagatgctggccctgcagttagctcccacctagtccgtgcacacacattctaatcccctcccattcctttacatgctgcggccagagaggcctttctcaaagtggaagtctcatcctcacttctctggttacagtgctgggccatggtaacttacaaggcttagcaggaactgtctgcgcactcccccttcctgcccactaccttgtttccctccagttgcgagagaaaacattgattgagcattaactatgtgccaggcttgtcctaagtcctttgcatgtattcactcaaacaatcctcacaacattcctatcacatctcccatttcacagtgagggttctaaagcacgtagtgggtgaggaacttgtccagggtcacacaactaagtgggggtggagaaacatcaaatctaggtggtccaggtggtggccagaacccatcagcacctcactacagctgcctccagtttctcgctctaggaaatactcttccctgtcaactcctgttgtcctctgggctcagttgacatgtcatctccttgaggaggacatcctgagatgctccccgactagggtgggcacccacttccacactccaaatgcctatttgacctgtgtatcgctgcatccccactgcctggcagatagcaggcccctaataaatatgatttgagcaaataaatatagttcttcaaaaaatagggaggacttcttgcttcaggtaatggtaggctaggacatttggaccaaccctcctgcagaaaatagccatttattttgatgcaatatatctggctatgactagagatttcaaatatttggagggctattatgtgaagaactaaacttactctttgtgacatagaggtcagaaattggtcgtttccatagagtatgagagagacagaattgtgctcatcataagtatcttttttaaaagttagacttaataaaatgggctgccttggtaggtggtgagttctctgtcacgaaagagattcagccacttgctctgagaaagcatggagaatatcaacattgtaagggtcgaccacctcatctctgaggccccctcctcacttaggttgccattgcaggtggaacactgggctgagtgtcaaagaacctgggttccacaagctgtgcgaccatggctggttgttttggatctcattcctaatatctgttagttaagctgacccgtcaatactgacccacttcacagagttatgaagggattaaattaggtattacatgtaaatctgttttgtttgctttttgttgttcttttttgttttgcttttttctttgcattatgaaatcccaagtcaactttttccattcttttatttttttaaaaattgacatcatcattataaccacaaaataatttttaaatggaaaaaaaaaactcacctgcaaccccacaatctaatacaataatcatact

SEQ ID NO: 347395 - DNA, 1092 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattagagctccctctttgcccactagcagggcattagctggtgctgaagacagtggctgcttggcgagcctggatctccaagtgaccccctcagcaactcctgatgaacaggtagcatgtaaaagaaatctttttggtttataccagtgagatacgggagttgtatatcattgcagcataatctaggctatagatgatgcaatactgctacattagggtctttgatttctagtcaggccctatgcctaggatagcttactgctggcacactcttcagccagtctctcagctctg

SEQ ID NO: 347396 - DNA, 3632 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggcactgatgagtaaggttggtataagttcctcagatcaacaaaaacccattttcctgtaagtcttacatttagtatttaaggaactaaaacttaaatacattttgtgaaatggttgacacttcactgataatgatttattgcttggattaataaattttccaaaagttgtcttatgtagaatatggtttgcaaccagcagaaccattaatctatactgcaatgatatgcactatgtataattgtttaaaagcctctacttaatgatgtaaaatgctctatttaattacacatttgggtaaactgtatactaacatctgatggcatttttccactgtttgttgcttttttcaaatactttattgtacaaagctgttcttaatatttttcaagtttttttctttgaattttgctaatgttttccttgaattatgagcactgacagaatgtgcttagcacttttggctattcacacagcttttgagcatgatttgcatccaatatttacattgctagcaataataagccatctgtgagttttgtcaaaagttattggggattttttaaattttagaaatgcaaattattgtttctttgaactaactcttatgcagttgcaaaggcatttccagttgttatagtttgtgtacaatatcaggtgttccagattatgattcattattaatatcattgcttccttgttccctctgaggtccagaagattcatgtttacaatatttagaaacaatgttaaaaaggtatccaaa

SEQ ID NO: 347397 - DNA, 2798 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtgagagccaaggcctgttctttccacttctggggctgtgacttgagtttctccgcaggagcagatagtgtttgtgtagggactgcggacttttgcattacagcctccctgctttgcccgcctgctgctggaagcttagcagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347398 - DNA, 2161 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347399 - DNA, 1959 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattagagctccctctttgcccactagcagggcattagctggtgctgaagacagtggctgcttggcgagcctggatctccaagtgaccccctcagcaactcctgatgaacaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaacccacactttcccattttgtgcctcccttcctagagttttagccaaaggtttagctaagtaattggttttaccagggcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggca

SEQ ID NO: 347400 - DNA, 3396 bp, Homo sapiens
cggggcggcaaaacgtccgcccgggcccgaggcgggcggaggcagctgtggttacgtgcggggggccggtgacgcagtcgcggggcgctgggacgcggcttgcggagccggccggcgagcgcaggccccaggctcgggcgcggcggcgggacagcacctaccttcccggcttcgggtccgggagtgcggggcgcggagccgccggagcgctgcctccctccttcctcctcccctcgcccccgccccgcggcgcgacacacaatactcgccggaagcggaagccgcgccgaggctcgtgtcagtggaagctggggtgtcggcgggcggccgcggccgggtctagcggtgcctgcggaagaaggaggaggagggctggcgatgagaagcagcagggggaatcaagggcaagaagggacccagaggggcaggtggctgagatgctggcgtccaggtgacccgaggaatcctctggagatacaggcccgcgcatgcgcgtgctcgagcgctgaagcccattgcccgcagggcgctggactggcgccccggccggcgaggctgtctagtccaggctccaggccccggctctggccaggcgccgccgcctcccggtgcagctgaaagtcgacgaagagggcggggcgggggcggcttgtggacttccacacttttcctctcttcgggccagtctggggagagggtggctagctgtggcggcggccaattacgtggcggacctgcggggctaagctggcacgtcacttccgactagtggagtttttagccttttaacattcaaggattaggtaagttctccccgcggtagacttcaaatactctttgtcctgcccctgcttggcgaaatttaccgaaattatctacctatcccgctggagtgggagccgggggagagctggaaccgcgtctctgctgctcacctttgtgtccttagctccttcgcatggggtccgaccgcaacacgtgcgctggataaacgcttgttaactgggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtgtgctcggaaatctcttccttaactgtgactttctgacaggtggaggatgtggtcaggagtgggaaaaggattcgagacgggaagagggaggggttcaggatgaagagagataatctgtgccacagatgctggccctgcagttagctcccacctagtccgtgcacacacattctaatcccctcccattcctttacatgctgcggccagagaggcctttctcaaagtggaagtctcatcctcacttctctggttacagtgctgggccatggtaacttacaaggcttagcaggaactgtctgcgcactcccccttcctgcccactaccttgtttccctccagttgcgagagaaaacattgattgagcattaactatgtgccaggcttgtcctaagtcctttgcatgtattcactcaaacaatcctcacaacattcctatcacatctcccatttcacagtgagggttctaaagcacgtagtgggtgaggaacttgtccagggtcacacaactaagtgggggtggagaaacatcaaatctaggtggtccaggtggtggccagaacccatcagcacctcactacagctgcctccagtttctcgctctaggaaatactcttccctgtcaactcctgttgtcctctgggctcagttgacatgtcatctccttgaggaggacatcctgagatgctccccgactagggtgggcacccacttccacactccaaatgcctatttgacctgtgtatcgctgcatccccactgcctggcagatagcaggcccctaataaatatgatttgagcaaataaatatagttcttcaaaaaatagggaggacttcttgcttcaggtaatggtaggctaggacatttggaccaaccctcctgcagaaaatagccatttattttgatgcaatatatctggctatgactagagatttcaaatatttggagggctattatgtgaagaactaaacttactctttgtgacatagaggtcagaaattggtcgtttccatagagtatgagagagacagaattgtgctcatcataagtatcttttttaaaagttagacttaataaaatgggctgccttggtaggtggtgagttctctgtcacgaaagagattcagccacttgctctgagaaagcatggagaatatcaacattgtaagggtcgaccacctcatctctgaggccccctcctcacttaggttgccattgcaggtggaacactgggctgagtgtcaaagaacctgggttccacaagctgtgcgaccatggctggttgttttggatctcattcctaatatctgttagttaagctgacccgtcaatactgacccacttcacagagttatgaagggattaaattaggtattacatgtaaatctgttttgtttgctttttgttgttcttttttgttttgcttttttctttgcattatgaaatcccaagtcaactttttccattcttttatttttttaaaaattgacatcatcattataaccacaaaataatttttaaatggaaaaaaaaaactcacctgcaaccccacaatctaatacaataatcatact

SEQ ID NO: 347401 - DNA, 913 bp, Homo sapiens
aacaagattcgctaatagaccagatgttgggtatgagacagagagaggagtcaagagtggtaccaaggtttttggcccaagcacctagaagaatagaactggcattaactgagagagcaggctgcaggagaagctggtttgtggaggaccatcagaagcacagttagacacataccaagttaaggatacctactacacatgtcaagtaggcagttggatatgtaagtctagaggtcaagggacaggtcttgaccacagatggatttggaagtcatcatcacacagatggtatttaatgccatgggactggacgagattcctgtcctagagaatggaacagaaaagtggagcggtccaaggactgattcttggggcactccaaaatctagagacaagggagatgaaaaggaagcaccaagataaatcaagatagtatattaactttagatatgtaaaaagaatttcaaccgttactaaggtcgaattaatgagaaaagtaacagacacaccatcaggaactctatagagatatagtgatacaggggtccccagagaaactccgaccagcttgtgcactgggaaaatggggtggagcttcgtgaagttcacgctgtttgcagggaaaaggagcctggcctctgtgatctggtgtggtaacctggggattcaatctgtgagatgtgggcctgttaacaggaacctctcttgctttgctgagttttttccttttcacccaataaaccctgtccttcctcacccttcaaattgtctgtgagcctaattttttgtggttgtgtgtctttagctgacctaagaaaaaagtcctacaataataatattgctcaaatgatgtgttctaggaagattatattagaaggaatactttatgacttgattttttttcatgtcaact

SEQ ID NO: 347402 - DNA, 772 bp, Homo sapiens
ccatctagttaataagagctcctctgacccacgcacatcaatacttacatcccaatggtgatgtgacattttgggttttgtatttcttttgcaaattgagctagcatttttgatgagtggcagggctctgctacccaacctttggacagtttccaagcataaaatcacaattccagataattctgtcacaaagatctgggtctcattaggaaggagaggaagctgggagatgatccagtccaacctcccccaaaccaaacatcacggccttctcagttgtttcaccaaccatctaaatgttttagtaattctaaaaattgatgcgctttttccacgaaaggaagtgttaccacattttccaagtgggaggcatctatatccttactccttcatcctctccttcccaccccctcaccccccaccacccacacaacatctgcaattcttaaactaaagcacaaattgttacaaaagttaattgcactttcaaaggaatgcttgtatagaaactttctcggcttcaaggaaaaataatacgctttgaatggctgttcaacagcatagaaattagctgagtagaaggcactcatatagccattaggaccaatcctttctgccgccaacaccccccttataaagacttgacagtgggccagaataaacaacttcaggatgaattcagttgagacacaaagtacacacttccagtttttcccttctctggttactggcctcaataaccaggcagtcaacttaaaaagaaaaacaaaag

SEQ ID NO: 347403 - DNA, 621 bp, Homo sapiens
tccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagccaaagtatccaccgaagagcaagtaacagcttcaggattcatcaggagcatgagaggataaggataattggctcacctcgttccacagctccaccttcatcttctcatcaaagcttatcatggattcatagggagcttctttccccttagcctgtgatctgcccatgatgttccctgatagcaaaaggtttcctttctaaggctgccatactgccactgtccaggtggagactgagcaaaggaaccttggctttgtcagttcccagagcttcagcagaaagagctgcagctgtgtgcctgggaaccatcagagaattctgttgatgtgttctgtgtctgtctttcacctgggcatgagcttctaccacctgtgcaattgtcacttttctttcactccctgaataaagtatctatgcata

SEQ ID NO: 347404 - DNA, 1274 bp, Homo sapiens
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcaca

SEQ ID NO: 347405 - DNA, 973 bp, Homo sapiens
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggcagggactgtcgacccgcccgcgaatttagtagtagtagtcgccc

SEQ ID NO: 347406 - DNA, 734 bp, Homo sapiens
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatcctgactggatgttctcagccccttgttctgggcaagaacccagagctccccagtgtggatactaataaacctcttggagcaca

SEQ ID NO: 347407 - DNA, 1673 bp, Homo sapiens
  misc_feature (1298)..(1298): n is a, c, g, or t
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacaaaaaaaaaaaaaaaaaaaaaaaanaaaaaaaaaaaaaaaaaaaaaaaaaaaaaaaaaaaaggggggggggggctaaaaagtttcccgggggggggccattagatggcgccgacaccccacagtttttgtgggaacaggggggggccccataaggagggaggacgaatataaaacagcagtgagggcgagaggcgcgggcgtgagttttatacacaacggagcgtgttgtaggagtgggaaacaacagagcggttaatggcgggggaccctcttttgtgtggagagcgaaggccaccctaatcttgagcggggggggggggagacacaaattttggtggggcaaaaagatatgactctacacgaggtattttagaggcgcctcagaggggggacatattt

SEQ ID NO: 347408 - DNA, 1210 bp, Homo sapiens
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcaca

SEQ ID NO: 347409 - DNA, 501 bp, Homo sapiens
atgggggtcttgttctgaacggatgaactgccgcctcactccagtcacagtggaagtgtttcgtgggtgtctgaggattggcacttgggaagggggcaagatgtgctcgtggaatgtgctgtctggtcccgccctctcagtttacagatggagaaactgaggcccaatagtacggaccagacctggggaggttggcatggccagggctgctggcagcaattgctggcctccatgaagactgaaggctgaggccagggcaggcccagtgatgagtgaggcatgaggaagggtcccattcattcatccattctcctggccctgctgttaagccccaggctgtcttccttcctcactggcttccagaaagagtagttgaggatgtccctgtccctgcttccccttcagccccagcagccccacttccaccctgagaccagggatgtccaagccacaagcagccccagctgacaggccacgcagccatgtgctctgcccagcgtt

SEQ ID NO: 347410 - DNA, 463 bp, Homo sapiens
ttcctataaccctagacagaagaattttcagaaacctcattgtgatgtgtgcgttcatctcacagagtggagtcttccgtttgatagagaagttttgaaaccctgttcttgtaggatttccaagtggatatttagaccactttgaagcctatgatagaaaaggaaacatcttcatggaaaacatagatagaatcattctcagaaacaactttgtgatgtgtgcgttgaactcaccgtctttaaactttcttttggtagagaagttttgaaacactctctttgtaaagtctacaagtggatattttgagcccttggaggcattctttggaaaagggaatgtcttcacgtaaaaggcagacagaagtgttctcagaaactgctttgtgatgtctgtgttcaactcacagagtttaacatttcctttgatagagcagtttagtaacactgtctttgtagaatttgg

SEQ ID NO: 347411 - DNA, 433 bp, Homo sapiens
gctggtcttgaactcttgacgtcaggtgatccgcccgccccagcctcccaaagtgctgagattacagaagtgagtcactgggcccagcctgtaaaccaagtattttggcttcagaactttgcttattgcctgaagtacaaaaagcaagtttcaggaaagtgggatcctatttataaaaaaaaaaataatcaaattatgtagatgcatgtatatatgtgcatgcatatatatgctcatattttaattattatttttggcaggatccacaagaaaaaagtaggaaggactgggggctcagggcaggaggaaaatgccaggagtgctagctcatgcctgtgatctcagcactttgggaggctgaggtgggaggaaggattgaggccgggagtttgagaccctcctgaataacatggtgagacctaatctctaccca

SEQ ID NO: 347412 - DNA, 421 bp, Homo sapiens
aaaaagtcatgtttcttttcttactgtgaaaataaagttactacttttagtaaattattttaagttatttatatattctggttacaagtcctttctcagaatattgtgaatattttctcccagtctgcggttttttttgaagagccagtattgttaattttaatgaagccttatttatcaagcttttctcttaaggttcatgcttttttgtatcataataagaaatcttttacgtaccctaggttatgaatgtttttatggttaggtatatggttgatttcaggttaggttttgtgtagggtgtgatgtaaaggtctagcttcattttctccaccataaatatttactcggtttctctggcaccagcctctgttttccattggtggctttattttttttctgttcttgaaacaagagtctc

SEQ ID NO: 347413 - DNA, 452 bp, Homo sapiens
ttaattgacaaggtatggtaacatgtgcaataaagaaacaaaagtgactgggcatggtggctcaggcctctaatcccagcactttgggaggctgaggtgggtgggtcactttgaggccaggagttggagaccagcctggccaacatggtgaaactctgtctctactgaaaatacaaaaaattattgtattttcagtagaatgaaaatactactgaatggtctcacacacctgtggtctcaggcactcagtaggactgaggcaggaaaatcacttgaaccctggaggcagaggttgcagtgagccaagaacgcgccactgcactttagcctgggagacagagcaagactccatctcaaaaaaaacaaaacaaaacaaaaaaaaggctgagcgcggtggctcacgcctgtattcccagcactttggggaggccaatgcaggcaaatcacgaggt

SEQ ID NO: 347414 - DNA, 185 bp, Homo sapiens
ctagaaaagtagaagaaaataaaataacctgttgttctacactctaagaataatcactattctcattttattttactttttattttatcttatttatttatttatttgagacagagtcttactctgttgcccaggctggactgcagtggcgtgatctcagctcactgaaacctccgccgcctggg

SEQ ID NO: 347415 - DNA, 411 bp, Homo sapiens
tgtgtctgagaattttgttttaaatgtgatttgattttacttaaatttgaactgccacatgtgactagtggctactgtattagtcaacagagagacagaatgccctgtgttagggatggctgtgctaacagaaggtggctggtcagaagggcagaattactgagcaaagacatgggaatgagaccagaaactcagtggaggtaatgacgttctgactggacagtgtgaaggtggcctggctgatctgccagaaagtctcctacctcagtggtaaatgactacgttatagaagcaaaactcaccaaaaccattcattaaaaccagccctttgctctgattctctgctctctttttcaagcttctgattaatatttaagtctcctaaataaattttcctacagggagaaaaat

SEQ ID NO: 347416 - DNA, 537 bp, Homo sapiens
ggaaaatgagagaggaggtcttcggataaatccggtgagagggaccaacttcaggaagggtggcttttgtggaatccagatggaaacctgagggaagggatgatattaaagaacagtggccccaggtaaaacatatggcacccatgtgtaaggtgattcttagaatctgtagaggtgtctttcgtggtatagaggttgaggcacctgtgcttcaaggaaaccttaactcttcaaaatcaggcaatgcgtatgaggtaaagagaggactgtgggaccataatcttgaagacagagacaggcttcactcatccctgcctcctgcaccagtgggttcaaggctctgtcagtgtcccctaggggcacctcaccactcccagcttcttcagctctggcctgtcctgctgcctgcaagggttttgcttaattctcaattcaatgtctcttcatcttttagtagctgtggggttttgttgttgttcttctgtttttgcttagtatctgactactttttaattataaaaagagatgtatctaaac

SEQ ID NO: 347417 - DNA, 445 bp, Homo sapiens
gaagttgcagtgacccaagaccgcgccactgcactccagcctggtgacaaagcgagaatctgtctcaaaaaaaaaagaaaaaaaattatctggggctgggcgcagtggctcatgcctgtaatctcagcactagtgagctgggaagtaatgtgcccaaaggctccaaatacaagcattctcttgtggaaggccttgtccactagcgtcagtgggtgtcaggagcgctgactgggagccagaggattgggttcaaggtgtggatccactgtgagttagcgatgctctaaggcactggagaaattacatcctagcgctttttaacatccgtttcccatgtagctttatcgcccacttcaaatacatacaaacagaggacattagataaagcccctctttttgtgaccggcctgggcaacacagcgagaccctgtctctcgctctaaaa

SEQ ID NO: 347418 - DNA, 687 bp, Homo sapiens
tgaacaaactatccctttccattgctatattccaatcttaaatttttgtgatatccatgagatcattttaaaatttttttgttgtgttgtcaattaattcaacctacatatagttttttgagtctgctaaatgccagatactattttgggtgctgaggatatagcactagacaaaataaacaagaatcctgactttaaagagtttttatgttggctggagagaagatcctgtttatttctcaaatgttatcatttgaagcaaaataaagaacttacggtgattttattagcacttcaaatgcctaaagtttggtttaaaatacattgttttgtagaaacatcctggaagaaaaagagcaacaagaagggtttttttgtttttacatgaacatgagtgatcaaacctaagattaaaccatattccatagatattagttttattagactagtaatgtagtagttatatatcttagtttaaatgtatcttttgatatgcatgtaaatggtcctttttgggttgtctgtattaaatcttgagaaggctcaaattgccctctaccggctgggcacagtggcgcacgcctgtaatcccagcactttgggaggccgaggtgggtggattacctgggatcaggagtttgagaccagcctgattgatatggtgaaactgtctctctaaaaaaaaaa

SEQ ID NO: 347419 - DNA, 124 bp, Homo sapiens
catcagttatgtaagatttaatgataaaatcacaataataagtaccagttacaattaacaaactggtttgggagcaagcctacctcttggcaagcctgcaattccgctggtgggagcagagctg

SEQ ID NO: 347420 - DNA, 493 bp, Homo sapiens
aatgattttgtttctctgtgcctgaatctcgtccttcaggagcttataatttagtagacacataagccacaaacagaagccagctctgtgtcaggccccatgagaagtccgcaggtgcgatcttcaatttggagactacaggaaggatggctggggaggcctcaggaaacttacagtcacagcggaaggcaaagaggaagcaggcagcggcttcgtggcaggagcaggaggaaggcggtggggaggtgctacatacttttaaacaactggatcttgtgagaactcactatcacgagaacagcaagggggaattctgcgccctgatccagtcacctcccaccaggctcctcctccaacagtggggattacaattcgacatgagatttgagtggggacacagatccaaaccatatcagtgtcattaaaaaaatagttgccctgctaacttttttaatcccctgtaactctaaataaaataatgatgtgaacataa

SEQ ID NO: 347421 - DNA, 582 bp, Homo sapiens
aatgattttgtttctctgtgcctgaatctcgtccttcaggagcttataatttagtagacacataagccacaaacagaagccagctctgtgtcaggccccatgagaagtccgcaggtgcgatcttcaatttggaggaaaagctgactaacattgaacatcaacacagacttcatctgataagaaacattcatgatctactctctatgaagcctgctacctggagactacaggaaggatggctggggaggcctcaggaaacttacagtcacagcggaaggcaaagaggaagcaggcagcggcttcgtggcaggagcaggaggaaggcggtggggaggtgctacatacttttaaacaactggatcttgtgagaactcactatcacgagaacagcaagggggaattctgcgccctgatccagtcacctcccaccaggctcctcctccaacagtggggattacaattcgacatgagatttgagtggggacacagatccaaaccatatcagtgtcattaaaaaaatagttgccctgctaacttttttaatcccctgtaactctaaataaaataatgatgtgaacataa

SEQ ID NO: 347422 - DNA, 395 bp, Homo sapiens
aaatgaggtatcatggaacttaagtattcattgtcctggaaggtaaggtccaggacaaaaaaaaaaaaacaacagtgggaaactttctcccacctccactaaatatacacctgagtaaacccttcatccaattactatgatttgatcattacacactgcataacgtgtaatgatgtctgagaagtatggggtgttgtccaaaatgctgtgtccttaacagcttagtttaacatctaaaatgcatgccatatgatattccccttttttgcaaaacctttctcatgaagctttatggaactaaaaaccagttgggatttttttcttcattcagtctgtttctatcacacaagctcccaaaaagaaagatagcaaaagcccccgccaaagaaacatag

SEQ ID NO: 347423 - DNA, 362 bp, Homo sapiens
gtagagttcatcgtggagaggaccaagacagaagatcaagaagaattttttttttaatctcttcccttgtccaccgaaagaccatcaaaactagagagagattatcaaatgcctggtgacaagtcctcggctgcactggcttcacaggagcttatgtggagaagaaaaagaatttgagccacagcaacgaaactctaaagttgtttccaactctcttaccaaaagaggcatccagcccaacagctctcaacctggagtaaagctcccacgtgccctgtggagcatcctcgctttgattccatccctttactcccattcagagaattctacttgaatttaaataaatgactcttctgctatta

SEQ ID NO: 347424 - DNA, 1399 bp, Homo sapiens
ttgctctgtcgcccaggctggagtgcagtggcatgatctcagctcactgcaacctccacctcccgggtttaagtgattctcttgcttcagcatcccaagtagctggggcaccaccacacccagctaatttttgtatttttagtagagacggggtttcaccatgttggccaggatggtctcaatctcttgactatgtgatccacccgcctcagcctcccaaagtgctgggatgacaggcatgagccaccgcacccggccagggcaatctgccatttgctggcaaccccagcttctgaggaggaaaggctcagaggagacaaaggtggcacctaatcacagatcttgtcaggctcctggactggaacaggcttagccatgctgtgccacgtcatggtccaaggcagcagtgacactctgctgaccccattctctgtaggttcccagtttcctagcgttctcccaaaacccagaggcttgaggcttccaaaagttcagaaggacaagactgcttcccaggctactgagaccaagggctggggttctctcttcccttgtccttctagacatctgctttctgcccaagcacatctcagcacctctggctaggcaggttcagcaagggcagtgtccatgctcatcacctccttatcctagcctgtcgtgggagataaatcttgataccaaggaacccgtctaaaccctcctccaagcctcactccctgaaccagcccaaacaaagagaaatacaccctaagcagaaagtctgaggtcacagaccacaggactgatcctcctctcacccataggggaaaccaggtggggtgtaggggagaataaatagagtggggacttgaagttagctgagctaggtactccagttctgccatctactaactgggagaccatgtgcaaaaagtgacaacttcttcatctttcagtggggtcataacgcacacctcatctcttatagggctgcaatgaggaataaatgtgtacaagggcccagcctggtgggtggccagcaaatggtagctattaggtgactggtatttgcggcttaactagcaatttcacatctcttttctcatctgactggtccccatacacaggcctttgaggaaggcagggcatgattaccaccattttactcatgaagcaattgaggctctgagagattacttaatttgctcaatggtaaacaaattctaactcctggccgctgatccaagctctaccgctttacagctgtgtgaaacagggctggctgctttgctctctgagcttccagttcctcatctgtaacccaggaggaatgccacctcctcagagaacattggtaaacatgatgtgaggcaattaagagctgacactttcatgcgctggccgtgtactagctctg

SEQ ID NO: 347425 - DNA, 538 bp, Homo sapiens
ataatagtttgtgattctgggtgtagaacataagactcactgaagtttctactttggttctttctttctctggaatcatgagccctgggggaagctggctgttgtgtcataaggaggcctgtggtccatgtgactaggaagtgagtcctcctgggaccagacaataagaagctaaagcctcttccaaaagccatgtgagagattcttgtgtcttgtgaatccccggccccatttgagccctcagatgattcagccctggaagacaactagactgcaacgttgtgagaggccctgagccagaagcattcagagaaacttctcctggattcctgaccatggataactgtgggagatgataaatatttgttgatttgagctgctaagttgtaggtgacttgttatgcagcagtagataactaatacagcttcacaagagaggatgaatcactgaactttttcatttgctctaaattcattataagatattaaacatgtcatttgcttttaatatttaataaaaatttccatggctatataa

SEQ ID NO: 347426 - DNA, 614 bp, Homo sapiens
cagagtcagactccgtctccaggaaaaaaaaaaaaaaaaagactaaagatgatcaaagattagaattacggaggtgtcctcaagaagaattggaacagatatggttaaaagtggctggaggtgggtgcagtggatatggtggtgcacacctgtaatcccagtgctttgggaggctgaggcaggtggatcacttgagcctaagagttggagaccagcctgggcaacatggcgagacctggtctctacaaaaaatacaaaaattagccgggcatagtagcacatacctgaagtcccagctactcaggaagctgagttgggaggattctttgaccccaggaggttgaggctgcagttagctgttattatatcactgcactccagcctatgtgacagtgtgagaccctatctcaaaaaaaaagtgatgtcgggaggctgagaggatgagtgactggggcaggagatgagtactttcccttttaagcccatagcatttaattccctggtggttcacttcttatttggataactaacaaattatttcaaatgtgtgcctataggtgagagaagcaatggtacatgaggaggtaagcatttgatttgtgggattatgaaca

SEQ ID NO: 347427 - DNA, 573 bp, Homo sapiens
aggcaggatgacacagtgtgagtaaaacttgaccagtcactgttcactttgagacagaagggaccagccaagaattgtgaatagtgtacagaagctctaaaagccgtcgatatatagctaaggatgataacaagcacaacaaggacttacagcatttgctttgcaccagacaccatctaaaacacttcacaaatattaactcaaaggaacctatcataatgctgtcattattcccagttcacagatggggaggtaaaaacccagagcttaatagcatgtccaagatcacataactattccactgctcaaaattactcctgaagggatgaggacaccaggatatgccaccggaccactgaaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtgaaaa

SEQ ID NO: 347428 - DNA, 489 bp, Homo sapiens
tttctttttctctttatagccgtcgatatatagctaaggatgataacaagcacaacaaggacttacagcatttgctttgcaccagacaccatctaaaacacttcacaaatattaactcaaaggaacctatcataatgctgtcattattcccagttcacagatggggaggtaaaaacccagagcttaatagcatgtccaagatcacataactattccactgctcaaaattactcctgaagggatgaggacaccaggatatgccaccggaccactgaaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtgaaaa

SEQ ID NO: 347429 - DNA, 459 bp, Homo sapiens
aggcaggatgacacagtgtgagtaaaacttgaccagtcactgttcactttgagacagaagggaccagccaagaattgtgaatagtgtacagaagctctaaaagaatgctgtcattattcccagttcacagatggggaggtaaaaacccagagcttaatagcatgtccaagatcacataactattccactgctcaaaattactcctgaagggatgaggacaccaggatatgccaccggaccactgaaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtgaaaa

SEQ ID NO: 347430 - DNA, 411 bp, Homo sapiens
aaaatcaaatccctattaggataaatgattgagtgttcctgtaaagaattgttcccctggttcaagcaaccagatttcattcccagatgatcaaaaatggacttgatgaaatggaaaagcactgatagaaacagttccactgctcaaaattactcctgaagggatgaggacaccaggatatgccaccggaccactgaaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtgaaaa

SEQ ID NO: 347431 - DNA, 494 bp, Homo sapiens
aggcaggatgacacagtgtgagtaaaacttgaccagtcactgttcactttgagacagaagggaccagccaagaattgtgaatagtgtacagaagctctaaaagccgtcgatatatagctaaggatgataacaagcacaacaaggacttacagcatttgctttgcaccagacaccatctaaaacacttcacaaatattaactcaaaggaacctatcatttccactgctcaaaattactcctgaagggatgaggacaccaggatatgccaccggaccactgaaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtgaaaa

SEQ ID NO: 347432 - DNA, 604 bp, Homo sapiens
aggcaggatgacacagtgtgagtaaaacttgaccagtcactgttcactttgagacagaagggaccagccaagaattgtgaatagtgtacagaagctctaaaagccgtcgatatatagctaaggatgataacaagcacaacaaggacttacagcatttgctttgcaccagacaccatctaaaacacttcacaaatattaactcaaaggaacctatcattaatctcagaggccacatgctgaacatggcctatccacagtgtggaagaagccttggatcctgagccactgttctgacaaccaaccaatttatagaagagagctacataattccactgctcaaaattactcctgaagggatgaggacaccaggatatgccaccggaccactgaaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtgaaaa

SEQ ID NO: 347433 - DNA, 409 bp, Homo sapiens
aggcaggatgacacagtgtgagtaaaacttgaccagtcactgttcactttgagacagaagggaccagccaagaattgtgaatagtgtacagaagctctaaaagaatgctgtcattattcccagttcacagatggggaggtaaaaacccagagcttaatagcatgtccaagatcacataactatcctgaagggatgaggacaccaggatatgccaccggaccactgaaggaatggtgatggtatgaagaaagtatttttaatgagcagagccatgtcctcacccctcaagagaatttcccttattattatgaaaactttttatcttaaaagatattacatgttaatggaactgtcgtttatgtaccaatcaagcacattgtcgaaataaaagatatgaaataagtgaaaa

SEQ ID NO: 347434 - DNA, 360 bp, Homo sapiens
cagtggaaaacttcccaggaaagcacttggaaaagtggataggaagagtagttacatggcagttttctgcccgtcccaccctcccttctaacgacttcttttatgtcaacagaactgccactttacttatctcaggatttctctttttcaggaatggtgatggtatgaagaaagtatttttaatgagcagagccattgtttgctctgctctgtcctcacccctcaagagaatttcccttattattatgaaaactttttatcttaaaagatattacatgttaatggaactgtcgtttaacaaatgttttataagtgtaccaatcaagcacattgtcgaaataaaagatatgaaataagtga

SEQ ID NO: 347435 - DNA, 726 bp, Homo sapiens
aagaaaggaataatacattacatggctcagcagtgaacagtgtttatgtaggtatagtgaggtaaacagtaaatattgatttaatttaaaatatgatattgaatgtattgagaagatgaggaagggaactatgtgtgggagagtagagtcaagttctcatattctttaagaaaaagctagtagataatgtatgggaaaggggataaagtgtttgtgtgagagcaaagtggtataagagtgctaaattctcttctttcatggtgggagcatagtagatgatgtctctaactggaggggaagggagaataagaaatcttaatataagcatattattcagaaatatgaggtaaagaagaaacagctaaaaggtgttctcagagtttggggtagatagtagagcagagaactgcttttttttcattataaatcttgtagtggtttagacttgttaaaccatacttatactttattaataataatatatgtgttatgtatgcatttatttttgagttccctatgtggaaaattaaaagggtaatatggtagaatttggagctgttattaagcggttctagccttggctttgtcccttatcatccctgtgactttgggcaggatgctcttgtcttcctgggccttagtttcttcatttataagaggaagaaggttggaaagatggtctccagggtctctttaagctgtaaaattcaaagattctatgattta

SEQ ID NO: 347436 - DNA, 576 bp, Homo sapiens
aggccccactttcttcaactgttctcgttattatgtggttcagggcctctcaccccatgacacagtttgactcatcactgcccttcttaaagtaggtagtgtgggaaaaatacgtggaaaggaatgtaggatttatagtcaaagtcttattcctaagtctggatattcatctttgtattagtccattctcacactgctaataaagacatacctgagactgggtgatttataaaggaaagactcacagctgactgtgactgactcacagctcatcatggctagggaggcctcaggaaacttacaatcatggcagaaggggaagcaaacacgtccttcacatggcagtagcaaggataagtgctgagcaaaaggaggaaaagccccttataaaaccaccagatctcatgagaactcactgattatcatgagaacagcagcatgggggtaacggttcccatgattcaattacctcccactgggtccctcccatgacacgtggtggggattatgggaactacaattcaagatgagatttgggtggggacacagccaaatcatatcaatcttcaaaataag

SEQ ID NO: 347437 - DNA, 323 bp, Homo sapiens
ctatgtcatcatcttcaggattattagagaagaattcccagattaaaagtatggagaaagatttgattcggagctggaaggaaaggaaaagtaatgttcactgagtaccttctgtgtactcaacttagttttagccattgtcacatgctatttttctgcatcccaagaccaatgggtatattatttccatgtaccgattagaaaactgaggcctagcaaattcattttattttattttatttatttttgagatggagtctcgctctgttgcccaggctggagtgcagtggcgcaatctctgctcactgccacctctgcctccc

SEQ ID NO: 347438 - DNA, 337 bp, Homo sapiens
gtgtgattcccaacaagcagcatcaggatcatctggaaacttgatagaaatgtaaattctacagtccctccttggagctacagattcagaaattctgaagtttaagtccagcagttggttataataagctctctaggtgattctgacttgcaccaaggttggtggaccaatgccttagattagtaaaaagcactgtcatagagtaagcactgccaaatccacagatattcattgaatggctaccagacataagatactatgtacactgattagaaaagtaaatacataaagcagatctcatgatgcttgcttctgcttttcactgtgtttaagagag

SEQ ID NO: 347439 - DNA, 829 bp, Homo sapiens
ccatcacacctggtaaaactgtatcattttttataacctagtcttagaagccatgcagcatcatatccatcacttccgtttgttaaaagcaaattactaaggccatatgtgttctggggaggggaattagactccaccttttaatggtaggagtgtcaatttgcaacatgtttaaaatcaccacatgtaacttctgataaatagatttataaacagtacatttgtacattagaaaagtttaaacataagaaacctaataaataccctcttttttatattagaatgaaatataaaaacccaaacatttaaatgttccagcaaagctaatcctgagccaacttgagtaggcagtctgtctcataatcttcctgcacctttcttctccctgtgtccattccctccaggtcaggcctcctgtgcacacatacccttctctcccaaactaggtaggacattcacagtagctgtacctccacggtgatgaaaacttttttctttgccctccatgagttatcccaactttggacctcataggatcgctggcaatcaatggcataatgtccttctcaaaattaaaaagcaaaatgctatggagaatattccagtaagtaattttataataataattaaaacaaaatgacatttcccaaaagggacaatatgcttttagatgttacgatattgactttattggggcttgtttattcatcaaaatcagtaattctaaaggaacagttgaggcttttaagtattttataagagtatgcatgtttcctatgaaggcgacgtaacacttgattattacaataaaaaaatggatacttctccc

SEQ ID NO: 347440 - DNA, 358 bp, Homo sapiens
ctcccatcaagccaataagagctattttcattatatccattttacagatgaggacagttaggcacagagaggttacatggcacagccaccatcacaccaccactgaggggcggagtcagaacccagacctccataatgtagctccagaattttcactcctacctccacactgtgctaaagaaggaagatgaggagccactccaagtagggaggggactctaggtcaaaggagagataatggacatgaatccaatgtttggcacaataacgtacatttatttaagttttcttttttaaaggtttctgtaaaccttttcaaaaaatgattcattccgtgccgggcatgttggctcatgcc

SEQ ID NO: 347441 - DNA, 701 bp, Homo sapiens
ggatattttctatgcatatacaaacatgggtgtgtttgggtagaaaactttttcttcctttagcataaacaggaatatagcataaacatatatatatgtgtgtatatatatatatttccttgcttttttcattatgtatattggataatctctctagatcaatatgcatatgttttcctcttttaacaatttgatagtagtccattgttcaaatataatttatttaccccaatttttaaaattaatatttaattatccagtttttccttggagtaagcatccataaatatgcatatatatgtacatatatgtctttgagcatttaggccagtatatcataagatataacaggtaaaaatcacaaggtaatgtccagtagtagaattgttgggtcagagtttgtggcttttaaatttgataaatatggcccagttgttctcaaaaaagattatgtcaagacaggcatggttgttcctacctgtaatcctagctacttgggaggctgaggagggagggttcgagaccaacttggacaacatagggaaaccctatcctttttttttttttttgagaaggagtctcgctctgtcgcccaggctagagtgcagtggcgcaatctcggctcactgcaagctccgcctcccgggttcacgccattgtcctgcctcagcctcccgagtagctgggactacaggcgcccg

SEQ ID NO: 347442 - DNA, 420 bp, Homo sapiens
agagtaagacctgaaaaagaaagaaaaaaagaaaagaaagagcggacaacaagaaatgaccagatatctgaggaaaacctccaacaacagattgctaaacaaacagaacacagcaacttggagtaatagagactctgcaggaagatgaaaactttaaaattttaaactataatcgatttccacttatggccatgactgactgtgagggaccagatttaccttcctgccctaagcagctagaaaactgggatatttggaaagtattttctgatactgaatagcaggctgcacaggactgtgactcctgagaggcgtgagtcctgaagacacattccatacccaagcagatgttgttaatcttactgagtcaagaaaaacattaggctgggcgtggtggctcacgcctgtaatctcagcact

SEQ ID NO: 347443 - DNA, 297 bp, Homo sapiens
caggggcggtgcgggggcgtgggcagcacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaag

SEQ ID NO: 347444 - DNA, 736 bp, Homo sapiens
tcaactattccaaaaataagattttcctccagtaagttatcattctcacttgataataagataactaagataactccccaaataaactcattcttcatatcttgcaaatctaaaaagcaacgtgcatcccctttcctgatgcctacccctgcactgtgctgacgcttctttcctgtcttgcagctgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatg

SEQ ID NO: 347445 - DNA, 1172 bp, Homo sapiens
gggcaagtgagcgagctccttcctcaccgggctgactagcctctcctttccctgtccccctccatcgctgctctgcaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatg

SEQ ID NO: 347446 - DNA, 1070 bp, Homo sapiens
gggcaagtgagcgagctccttcctcaccgggctgactagcctctcctttccctgtccccctccatcgctgctctgcaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatg

SEQ ID NO: 347447 - DNA, 844 bp, Homo sapiens
caggataggaagaaaagaaagtttatacctggttaattcgtcactgaaaacaattttctaacacctctgttctgtaaagcagaagagctgtgtagatgttccagagtcgcttggtgtaaatttggttctgatttgtgccgtgaagcccaataacaaactggaggcacacatttcaaagccagtgattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatg

SEQ ID NO: 347448 - DNA, 305 bp, Homo sapiens
gttcttccagtttcttcaatcagatgagccacactgtcactctagtgttgaaaggagggaagggacagaggtggccaggagtgtgaccctaaaagaggcagaggagacctcagagaaagagaagaagcattctcctaaccagagggagaaggagagaggcctcagttctccctctctgggaattaatttgagatttacatttagtgtctataaacatgtcagcagatatataaacttatttgcttttgctttgtttccatttttagattcttgagtatcagaacaccaccttctttggtggaacc

SEQ ID NO: 347449 - DNA, 1756 bp, Homo sapiens
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccagcttgttgggagtctacgtcacggcttgtcttgggaaccaatccgtctctctttcttttctttgaagttcccaataaaatgaaaacaggaaatgtattcttctgataatcatttgtctgactcctctagcctgtagctgctgctactgctgcttttttttcctttttttttttgaggcaagatcttgcttcgttactcaggctggagtgcagtgggacagtcggctcactgcagccttgaactcctgggctcagttgattctcccgcctcagcctcctgagaagctaggactacaggtatgtgtcaccacgcccagctaatttttaaaaaaatgttgttgagacagggtctcactatg

SEQ ID NO: 347450 - DNA, 1586 bp, Homo sapiens
accacctctgctgccgcgcgcctaccggagccgcttggccctagtgctttccagcggatttcccctcaggtgcggagccgggtgccggggtcccacagccaaccactaccggttcctctttcgtcagccaccggcgccggcaggacccgcgaatcccgatctccaggagcctgtaaggaggccgcccattggctcagccgcactgctgggcaggtacttccaaagctttgaggattggctgatgctctgggcgccggggctagttggcgggtaggatcacgtgcgaggggcaggccccgtctaggccccgcctccttgctgctgctgccgccgccaatcctggtccggttgcccgagttcccggaggtctctcgcgggacctctctcaccgccaccgctcctactctcgggcttccaaatctggggcgatgtctccccaggttaaattaccctagctcctgctccagatcgcttccccgtgccccgccagagcccagtagttcaaaaattaaatttggggcaaggggtgcgcgccagagcgcagctgtttctggagcctgcggcagcggtggcgagccacagggcggcgaccgtgagctccgggagctgcgcaaaccacctggagaccatgtctggggatgcgaccaggaccctggggaaaggaagccagcccccagggccagtcccggaggggctgatccgcatctacagcatgaggttctgcccctattctcacaggacccgcctcgtcctcaaggccaaagacatcagacatgaagtggtcaacattaacctgagaaacaagcctgaatggtactatacaaagcacccttttggccacattcctgtcctggagaccagccaatgtcaactgatctatgaatctgttattgcttgtgagtacctggatgatgcttatccaggaaggaagctgtttccatatgacccttatgaacgagctcgccaaaagatgttattggagctattttgtaaggtcccacatttgaccaaggagtgcctggtagcgttgagatgtgggagagaatgcactaatctgaaggcagccctgcgtcaggaattcagcaacctggaagagattcttgagtatcagaacaccaccttctttggtggaacctgtatatccatgattgattacctcctctggccctggtttgagcggctggatgtgtatgggatactggactgtgtgagccacacgccagccctgcggctctggatatcagccatgaagtgggaccccacagtctgtgctcttctcatggataagagcattttccagggcttcttgaatctctattttcagaacaaccctaatgcctttgactttgggctgtgctgagtctcactgtccaccccttcgctgtccagaattccccaggtcgactcgccaagcaatcaaagggcgtccaacagtggctttagatctcctgagtgtatggacttcattcgcaatcattttagtggcttcgtcaaaatcaagtgcaaaggaaagcacattgggtgtgatgtcatgcagaatgtcccttaatgcctccaattggtcagtgctggttgcagtcagcctg

SEQ ID NO: 347451 - DNA, 597 bp, Homo sapiens
ttctagaggatcccggtgtgtccttgtctcctaattacgtataaaactgactttcgccgggcatggtggctcaagcctgtaatcccagcactttgggaggccgaggtgggaggattacaaggtcaggagttcatgaccacactggccaacatggtgaaaccccttctctactaaagatacaaaaaaaaaaaaaattagccgggtatggtggcacacacctgtaataccagctacttgggagactgaggcaggagaattgcttgaaccagggaggtggaggttgcagtgagccgagatcacaccattgcactccagcctgagcgagagggcaagactctgtctcaaaacaaaacaaaacaaaacaaaacaaaacgcaagactctgtctcaaaacaaaacaaaacaaaaaacaaaaaataaaaaacagtaacaaaaaaccttacaaggtatcctgaagaaaataaaagggaccaattgaccagaaaccaagagaaaaatccaactgtagaaacagaattgtagcaactcagatattggattataggacaaagggaaacaccccactgcattccagccagggtgacagggaggctgtctt

SEQ ID NO: 347452 - DNA, 889 bp, Homo sapiens
ttctagaggatcccggtgtgtccttgtctcctaattacgtataaaactgactttcgccgggcatggtggctcaagcctgtaatcccagcactttgggaggccgaggtgggaggattacaaggtcaggagttcatgaccacactggccaacatggtgaaaccccttctctactaaagatacaaaaaaaaaaaaaattagccgggtatggtggcacacacctgtaataccagctacttgggagactgaggcaggagaattgcttgaaccagggaggtggaggttgcagtgagccgagatcacaccattgcactccagcctgagcgagagggcaagactctgtctcaaaacaaaacaaaacaaaacaaaacaaaacgcaagactctgtctcaaaacaaaacaaaacaaaaaacaaaaaataaaaaacagtaacaaaaaaccttacaaggtatcctgaagaaaataaaagggaccaattgaccagaaaccaagagaaaaatccaactgtagaaacagaattgtagcaactcagatattggattataggacaggaaacatgaaaattgctacaatcgatatattcaggaaaacagaagaaaggatatgttttagcacctggaatccattttttaaaagagtccaacagaaaatatagaacagtgactcaaatgaagaactcggcagttatgcttgatagaggtcagaaacagcagagcaaaaggattaaggagctagaagacagaacagtagaagcatgtcggttgatgcacagatgtggaagataagggggtctgccaggtttctgccccggggactggatggggccgccttggacgcgtggacttcaagaaaaagagcagttgtgggagaagatggggagttttgtttagga

SEQ ID NO: 347453 - DNA, 5920 bp, Homo sapiens
tacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaagagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacctagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgttttgccaaaagctgctttctcatgattattctgattgatcatctccttcagagaacatgtgaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347454 - DNA, 3720 bp, Homo sapiens
ctctgcgtctttgctcccggagcgcttgaaggagctgcggggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347455 - DNA, 3299 bp, Homo sapiens
caggacatgaagtaagacgcccgagggccaatggcgcgcctcctgctagagctttgaatgtagacagacccgactggtgggtggcgcggccacctgtatgcttcttgcacagtgcgaggggtggggggacttggagacagaagctggaaaatgggctgccccagcagcaaactgtgcctctattctccatgtgcagcaacaaggcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347456 - DNA, 2904 bp, Homo sapiens
accctaaccacctctcaaggccattttgagaacagatggccaatttacataaaagcatactatagatgtaaagtaacgtcatacggcttcatcatcaacccctacatctatatgctttaactgttttagagtacattgatctcatagaatgttattgcctcaaaaatatccgtttattttcccagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347457 - DNA, 2600 bp, Homo sapiens
ctagaggatcccacctcctacccacgaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347458 - DNA, 2635 bp, Homo sapiens
catgttttaaaaatacccagccgctctgttttgctgttttaaaatctttttcagtatgtttgttagtgtataaatattttaatatggaattgcattttccttaattaaatctccaaagtgtgcttgtgtcgtgaggtgccttaagaaatgaggggttttttttttaatattgtataaatgttggaattcttgtttatgccaaggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347459 - DNA, 4870 bp, Homo sapiens
tacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaagagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacctagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctgggttaggtctacctgggttaggtctgcctgggttaggtctacctgggttaggtctacctgtagccacctgggttaggtctacctgggttagtctacct

SEQ ID NO: 347460 - DNA, 3279 bp, Homo sapiens
tacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaagagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacctagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaaca

SEQ ID NO: 347461 - DNA, 3272 bp, Homo sapiens
tacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaagagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacctagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgctattggaacagaaacaatgtttgaaagtttgatcacttgctctg

SEQ ID NO: 347462 - DNA, 112 bp, Homo sapiens
cagaatggttcctcaggatccttttatttgaagcctttggtatccagggctcatgttcacttgatgaaaactcctccaaaaggtacagtcctcattgtggtttgaagaggga

SEQ ID NO: 347463 - DNA, 457 bp, Homo sapiens
atgttcctaattctctgttccccataaatcttttaaagtcataaatgaagccacggtccctgttcatgaattccaaccatctagatctccgattcattccagttctcatccatatgcattccttacagcaacataacttaaatggatttctgtggcttatctggttgtttttgaatccttgtggtggtgattttaaaaattaacctcacctatctttgtacctatgttaattcgttttgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgag

SEQ ID NO: 347464 - DNA, 207 bp, Homo sapiens
acaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgcatcctctgaccta

SEQ ID NO: 347465 - DNA, 5859 bp, Homo sapiens
tacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaagagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacctagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347466 - DNA, 3731 bp, Homo sapiens
agcatgcacagtgtgatgtggttcagaggcagcttctagacctgcaggagggagattgtattcagaggaagagcatcattttggcaacatctgaaagtgaaaacggaagccagaaacacttggccagccctgggggatttttttcttctatgcctctctggtggaatgacatttgctgtgtaggcatctttcctctgactgtatttcttggccttgaagagtactgagtttaaaaagacagtatgtgacagtccatggaaattgcctcttctgtgaaatctcgccacctgctccgaagacatgttgttgtctcccaaattctccttatccaccattcacatacgactgacggccaaaggattgcttcgaaaccttcgacttccttcagggtttaggagaagcactgttgttttccacacagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347467 - DNA, 3326 bp, Homo sapiens
atggcctcccaggtgtgatggcctcccaggtgtgatagcctcccaggtgtgatggcctcccaggtgtgatggcctcccaaagtgctgggattacaggtgtgagccagtgcgccatgccctcgtgttcctttttacagttcacttccatactgttatatttgaagacatggtcactagagacccaagacatcatgggtgtatgcttcaggtgtcatcacagctgtgtgtgactgtaatgaatataggacatttcacaaataaaatgacctcttccctcttctttctcctctgttttcagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347468 - DNA, 5476 bp, Homo sapiens
tacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaagagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacctagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaa

SEQ ID NO: 347469 - DNA, 428 bp, Homo sapiens
tcaatagcatgggcaacagtgtggaatcagaattgtgtgatgggaagttcataggtttactctcaaataaatgtggatttcatcagcctttgaagagcagtcaggccttggacaagttttggacagctttacgctgttttttcttcatcattaaaatggagtcaataatatgtatccaaaaggtaaaagtggaaaattagaatacagaatggtgtattctcattaaatgctaacattttcactatcacttcttcctttctacctggtcatataatctttacttctgaagaaaagcagaggcaaaaataatagtctacctagtgacaaagaactcagaattatttacataaaatatatactaaaatattaaataatatcatttgtagttgttattttatacatatgatacatatgagaaggagttgtgg

SEQ ID NO: 347470 - DNA, 363 bp, Homo sapiens
ggagggggatgaagagagctgggttaatgggtacaaaaaaacagtcagatagaaagaataagttctactattcgatagtagaatgactacagtgaacaaaaatgtattgcatatttcaaaatagctggaagaaaggacttgaaatgagcccaataaaaatgataaatgcttgaggtgatgggtatcctaaaaccttgatttgattgttacaaattctatgcatgtaacaaaatatcacgtgtctataaatatctataaatattatatatcagtaaaaaagcaacttgcttggaactgattttttttaaaaacaacttatattcttccaatcataccatctacagctgataagggtctatttgc

SEQ ID NO: 347471 - DNA, 645 bp, Homo sapiens
tgtagggggagagcaggaagtgatctggaatattgccatcaggattgagaaaggcagcctttcagaatttgatgaaatgtgtgagatcaaaactcacaaggcagtcttaagtaatagggtaggtagtggctatgtgttaattctccaggagaacacagactatcacttgaaagttagcctaaatgtaaccgaagagtccaaaaattttcccattctctgaaaatagattaatctctacttctaagcaatattcaatatggcatgacttaaaaaacagggagaggctctctatttggaaaatatcctctccctaattgctagagatgcacactttagccactaagtcaagataaagtccctaaaggctctattcatgtgtgttggtaatttaaactatcaccatccattaagacggcatgacttagtctacggaattagctctaaccacttcataagaaattgagaagatagagggcactgaacagatttcaaatttctttttttgtggggtgctagggagaggaatgcccacaacatgtctgggtgagtgtggaagccaaaagaaactatgcagggtctcaacaccagaagaagaggtgatgtaaacagaaagtagaaggatgctataaaccggctctgatcacg

SEQ ID NO: 347472 - DNA, 1662 bp, Homo sapiens
ctgctctgctacgactgcgtgggtgagtcgtctataaaaactcatctctgcgcgtctcttcggccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347473 - DNA, 1436 bp, Homo sapiens
ctgctctgctacgactgcgtgggtgagtcgtctataaaaactcatctctgcgcgtctcttcggccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaacttataatattataattatagataaatactctagggggggcccgtgacccaatttggccatatagcgagttggtttacg

SEQ ID NO: 347474 - DNA, 1537 bp, Homo sapiens
ctgctctgctacgactgcgtggtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347475 - DNA, 1608 bp, Homo sapiens
ctgctctgctacgactgcgtgggtgagtcgtctataaaaactcatctctgcgcgtctcttcggccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaactttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347476 - DNA, 1610 bp, Homo sapiens
ctgctctgctacgactgcgtgggtgagtcgtctataaaaactcatctctgcgcgtctcttcggccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347477 - DNA, 405 bp, Homo sapiens
taataccattctaaaaaatgttttctctttttttcccatgcctattgcaaattttgtgcaaaatctggttcttaatcattattacattggtttacctttgcatcacatatgaatagctgtactttgctacttttgactaatactttttcttccaagagttagaatatcatagcataatgtttcaagaggattattgttagattggcacaatagttaaaggaatgctttaggacaaatgtctgaaatgtgatatttaagcttggtcctagatgtccatgttgagatttcctgggaataaaatggcttagttgggcattggacagtgtagttaagtaaaccctatcttgacaaaatgattcagatatgtgcttatattcttagggtgaccgggttattgatgtggga

SEQ ID NO: 347478 - DNA, 426 bp, Homo sapiens
gcaggagaatcacttgagcctaggaggtggaggttgcagtgagctgagatcatgccactacccttagtctgggcgacagagtgagacttcatctcaaaaaaaaaggtgtgatgaacattaaagttaactgagaaatttgcagttaactctgtgggaagtatcactgagatgattagggtttcatctttaaggtatgattgaatgttttacaattagaatgtatattatgtttataattagaaatggtagattttaagatgaactatatggcttaagtgaattgatttatttaattttttttcttttagaaatatgtgccgtatcacgaatttctaagaaagaaattggtcggtgttttaaacttattttgaaagcgctagaaaccagtgtggatttgattacaactggggacttcatgtccaggtt

SEQ ID NO: 347479 - DNA, 654 bp, Homo sapiens
tctcgatctcctgacctggtgatccacccgcctcggcctcccaaagtgctgggattacaggcatgagccactgcgcccggcctagctcccgctttctaccttttagtatgtatttctattatcagtttttagaaatcacttctggttttgtttttaagtttggcactttatactatcatatctcacaaattacaatgcaggtagtggaaaggaggtaggatggaaatgatggttaatgtttcgatttttgtcttttagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataa

SEQ ID NO: 347480 - DNA, 1896 bp, Homo sapiens
ggaattcctctctttattgtcagggtcctctccctaggaggcctgcccccgctaaccggctttttgcccaaatgggccattatcgaagaattcacaaaaaacaatagcctcatcatccccaccatcatagccaccatcaccctccttaacctctacttctacctacgcctaatctactccacctcaatcacactactccccatatctaacaacgtaaaaataaaatgacagtttaacatacaaaacccaccccattcctccccacactcatcgcccttaccacgctactcctacctatctccccttttatactaataaggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347481 - DNA, 1878 bp, Homo sapiens
agatcatttaagattaatgtgtcaaaaaaagatgaatgtgtcttctgcaaactgctttgttgttcaaaataaattgagctaattattaatatcacagataacaagtagcttttgaaacaatttcttgaatgataaattcaataactcaattctggactaaaggaaatcatcaagtcttaagttcagcagagcaacttctaccatccctcatttctatacttactgggttcagtgtactatttaaatctgttactaaagtagttaacaagtagaaaaatacagagagaaattgttctctgactagagaaataagtggcaaagagcacaaactggatggtaatgtaaatgctgcaggttattacgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347482 - DNA, 1363 bp, Homo sapiens
ctgctctgctacgactgcgtgggtgagtcgtctataaaaactcatctctgcgcgtctcttcggccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaattggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattcccccctcctcctccatggagtgggcttgagtccgtagagccgagagccttagatgaagtgcccttgatataaccccctatgtttttggtgggtatcgaggcccccgatgttcttgattttcccagagaaggaaattaacagagtgaacagccccaaaaaataaaaa

SEQ ID NO: 347483 - DNA, 1370 bp, Homo sapiens
ctgctctgctacgactgcgtggtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaagtttttgttatatgttacatgtaacttatgatacataattacaaataatgcaaatcattgcagctaataaagctgatagactttatttccattacttatatatacatagttttttattttaataaatttatggaaagagcaaaagcttttgagaaccattgttaacatcaacatcatagtttccagtttgaaaggatgtgtatgtgagatttattatgtatattattaaacaagaagtgatgagcttgggccttgaaaggcaccagcttgagagacattaaaatgttctaagtaaaaaaa

SEQ ID NO: 347484 - DNA, 1123 bp, Homo sapiens
caagaaagaagtggtttttccaggcagggaataaaggcaaattatgctagcttcacatctgtgcctaaggctcctattgacaaggactctctgcattaggtagtaaataactagatgtatgaatgctgctaactttataaaagaaaactgtaatttcattaccagaagtacaatgatttaattattatgtcagagcttctacattcattagtttatatttacctacttgcccattagtgtatatttacaagtcacagtttcttaaattttatagggactctcgatgcagaagattaaagttcatgaaaagtcagtcttagggtgcttcttaaatttacaggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtgggtaggttaaccattccttatctccttcagcagttacaccccccaaatgaaacgaaaatcaagaaatgtgaaacaaccatttgattccacaaaa

SEQ ID NO: 347485 - DNA, 581 bp, Homo sapiens
caggtaaattccttttgtattgccatttgagtttaatcccatgtagtcttttgttctggttaattgctgtcctgattgctatactaccaaatcaaaatgaaaactgcatatctgccaaaagtgggaatgcaaccagaaaattcacattcagacttcattatgttgttagtggcacatcttcatacacacacacacacacgtaaataaaataaattagaaataaatggaggtggggaaggaaaaagtgagagctgtcacagcaatttgaaattaaacctctattatttcaacaggaaagaagaataagctacgagtttactatctttcatggttaagaaacagaatactacataatgacccagaagtagaaaagaaacaaggctggatcactgttggggacttggaaggctgtatacattataaagttggtaagtctcaagacatggaattataagtttggtctgtttactcaatcagacttacttagttaggtttcacctagttttttctatcagattgatgatgcatgtgtgaccagcttcagatgttgctggaaccttcagcattatttatatttttta

SEQ ID NO: 347486 - DNA, 161 bp, Homo sapiens
cggctgatctagagatccctttcttgccaaagactcgtgagcagtacaatgtgggaatggtggggacgcatgggctggagacctctcatgcggacagtttcagcggcagtatttcaagagaaggaaccttgatgattagagaggtaagttggtataaaaac

SEQ ID NO: 347487 - DNA, 6976 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347488 - DNA, 6952 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347489 - DNA, 6787 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347490 - DNA, 6700 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347491 - DNA, 6898 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347492 - DNA, 5530 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcc

SEQ ID NO: 347493 - DNA, 6724 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347494 - DNA, 4671 bp, Homo sapiens
atttcagtacagcagcaatcataagaggggaaaagccatcactgtggcttgggcaggagtcccagaatactggggcacaatttctaatcccacatattttcccattaactctgggggtgaccagcttcacctttccaaaacaaaatgagaacccaatgtttgtatatatgtgtacatacacatatgtacacatatatattcaggactgaacagtctcagtctagctattggttttgaaaaagtttaaattgatttcatctttcttttctagcttctacacgctacaaacatcattttcttagttccatgcagtaactatgtttgtcacagttctatatagagcttttttttttcttgttgcttaagctggagcactgacttgctgagagatgtagctttggtcgtatctaccactcatatgctgaacaaatttttctttcataggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347495 - DNA, 3804 bp, Homo sapiens
caagaaagaagtggtttttccaggcagggaataaaggcaaattatgctagcttcacatctgtgcctaaggctcctattgacaaggactctctgcattaggtagtaaataactagatgtatgaatgctgctaactttataaaagaaaactgtaatttcattaccagaagtacaatgatttaattattatgtcagagcttctacattcattagtttatatttacctacttgcccattagtgtatatttacaagtcacagtttcttaaattttatagggactctcgatgcagaagattaaagttcatgaaaagtcagtcttagggtgcttcttaaatttacaggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347496 - DNA, 2658 bp, Homo sapiens
gagaaaatggatggacggttgaagaaaagaggggaaaagaccatgcagttgaactaacttctttttaatttcaaacaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347497 - DNA, 558 bp, Homo sapiens
gtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtaatatttactggggtgttttttttaatcaccagcatcactgatgatttttattaccactattccagacctttcgtagtagtggagaatgtgatcatgccaaagcacttccccttctcatgtttgttttggtccctcttcattccctggctaagacttggtattgccatttaccatgtctgacctttatttcccccgcaagaaaactgaagtcaggtagattgaagcacagatcctacgtccaaagttagaactctcaacaccaagtattccaaactgtcattttgctatccatattaacaaataaagtaatggatatttcattgatga

SEQ ID NO: 347498 - DNA, 327 bp, Homo sapiens
agagatgtagctttggtcgtatctaccactcatatgctgaacaaatttttctttcataggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgatgtaagagaactacttttaaagtgtagaccgggaggggactaggtttccaaaataaaaggacaaaaaaatatgagttaaatgta

SEQ ID NO: 347499 - DNA, 460 bp, Homo sapiens
tttcatgacagaatttttatattgttctcatacaggatgaagaggaagaaatcaaacaagaaattaacatgttgaagaaatattctcatcaccggaatattgctacatactatggtgcttttatcaaaaagaacccaccaggcatggatgaccaactttgggtatgtactgccgtccaaatttgctttatttacataaaaaacaaacacggccaaatggttcatttttctatcctcatgacaaaatttgattaactccttctttaaccattagcccccatgatgtccgtaacatattgttttcagggttttctcccatttccttgaatatctgtcttttcaggatctctaaatgttccttctatcccttaatatggaccatccccaaagccaattgttaagttctctgtttttttttttttttttcactaattgacaaccttttattgtgttttatttta

SEQ ID NO: 347500 - DNA, 300 bp, Homo sapiens
gttttattttttaaaagaataatgcttggcttttctttgtcttctagattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtgggtaggttaaccattccttatctccttcagcagttacaccccccaaatgaaacgaaaatcaagaaatgtgaaacaaccatttgattccacaaaa
